United States Patent 7,413,875 (ESTS AND ENCODED HUMAN PROTEINS) - sequence listing, part 3

SEQ ID NO: 15648 - DNA, 411 bp, Homo sapiens
ataatagccagtggattttgtacttgcttaccctggactgagtgtcttggtgtcctgtttgatttagttggggtagttgtaaagcaaacagtgtaggtattggaagccgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagctt

SEQ ID NO: 15649 - DNA, 466 bp, Homo sapiens
tcaaggtagtgcctggtggtgtggaaaatcattttgaaatttctgacatctaaaatcttaggcgtttcagaccacattcgcctgagtgatcttatagcagccagaatcttaaggtatacagattttgatactttaatatacacctgtgctacsgaatttgacttcatggaaaaagcggtatgaatgtttcctttttccttctttactaatatgagtttttgctctaggtttttttaaaatctgaaactcaaaatttttgcacagaaacagtcaacttattttattttttttactgtaacttttgctaatctaccttcctcacttgtttttttgtctgttaaaaaaaaaaatagcctctatcttatagagttattgatgatggttaaatgrgataatcggagaagagtgtttaacatactatatgacccataataattactattattacaaatcaattacttttaat

SEQ ID NO: 15650 - DNA, 526 bp, Homo sapiens
ttgtgtatgagtgtgaaacaatgcagactttggagtatctcattagaaggactgtatgaatttatagaaaattgaatctaatttcagaagagcgcactgtcttctcagtcaacaaggttgcccagccacagagggtcagagaaaatgtcctttacccctccccactccttttcatagaatcctctctcaggcctaactgagctgtcatatccaattcagactgacacagagtgaggggcgctgagagtctctatgtatataaagatataggaagaaaataaggatcatcacaggaatctgttgggcttctccccatgactgtgatcttacccatgtttgaatcacaaactttaaatttataataattatgattcttgcagttttcaagtaatttgttaaatgcctattcaacacagacagatttttattttcagctgtggcttgtaaatgcctacaaactgattcatgttggtggtcgttatgacactttctgtgaattrgtgaataaatatgattttmgaatttc

SEQ ID NO: 15651 - DNA, 425 bp, Homo sapiens
tttctgcttccgcgaccccggcggtgcagggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcataaaaagaagtcaatgtaaacgaagttaagatcaaccacataaaacatttcatgtgcaataagctctcaatcaagtaaataaagtttaagttgyarwmwaaaaaaaaaaaaaaa

SEQ ID NO: 15652 - DNA, 373 bp, Homo sapiens
agtcgcggagtagtcctcatggccgccccgccggagcccggtgagcccgaggagaggaagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaaaagaagtcaatgtaaacgaagttaagatcaaccacataaaacatttcatgtgcaataagctctcaatcaagtaaataaagtttaagttgtagtctaaaa

SEQ ID NO: 15653 - DNA, 399 bp, Homo sapiens
agggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgt

SEQ ID NO: 15654 - DNA, 371 bp, Homo sapiens
agtcgcggagtagtcctcatggccgccccgccggagcccggtgagcccgaggagaggaagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaaaagaagtcaatgtaaacgaagttaagatcaaccacataaaacatttcatgtgcaataagctctcaatcaagtaaataaagtttaagttgtagtctaa

SEQ ID NO: 15655 - DNA, 370 bp, Homo sapiens
agtcgcggagtagtcctcatggccgccccgccggagcccggtgagcccgaggagaggaagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaaaagaagtcaatgtaaacgaagttaagatcaaccacataaaacatttcatgtgcaataagctctcaatcaagtaaataaagtttaagttgtagtcta

SEQ ID NO: 15656 - DNA, 370 bp, Homo sapiens; identical to SEQ ID NO: 15655

SEQ ID NO: 15657 - DNA, 467 bp, Homo sapiens
attggaaaaacaaaaacaaaaaaaaacctttgttctgtaagacagtatagaaagttgggagaaaggtctactccaggatcaagacctcctgaaaggtctcgaggaccccaatggttcctggaccacactttgaaaactatggatctgaaaataatttaggattgcattttcctgtaatgccgcgtcttagcaatgtgaccttgggaactggaccaacaggacccaagggagagtatcaaaggcaaaacaaaggaaaatgaggacaacccaatactcagaaaaaaaaacgagtaattcatggattcacaacgggcaacaaactagatgactattaggaagagaagagcaaaccttatgatctcaaaatgatttcttgttcatttgcatcctcgcatcaatctagactttaagaaatatgtgatttttaaataaatgggtatatctgaaaaaaaaaaaaaaaatgcgaa

SEQ ID NO: 15658 - DNA, 397 bp, Homo sapiens
attttcycatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaacta

SEQ ID NO: 15659 - DNA, 697 bp, Homo sapiens
  misc_feature 135: n=a, g, c or t
acatgataaagtcagcacacacaaaaaggcttcttacacatacctgtcttaaaccatgtgtagagctttaaaaacagaaaaaaaaccccatatacttatgaccatcttaaatcaagaaaattgcatatttccatnctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcaaaaaaaaaaaaaaatgc

SEQ ID NO: 15660 - DNA, 215 bp, Homo sapiens
attcctcctaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctgggggaaaccattcctcgactcagttatc

SEQ ID NO: 15661 - DNA, 308 bp, Homo sapiens
tttgaaaagctcagatacacacgtttaattcactcaacttttccctcttcttctaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaaaaaaaa

SEQ ID NO: 15662 - DNA, 207 bp, Homo sapiens
acgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaa

SEQ ID NO: 15663 - DNA, 207 bp, Homo sapiens
acgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcvaagktgggaa

SEQ ID NO: 15664 - DNA, 210 bp, Homo sapiens
acgtgacggakcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaatgaaactgaagrttgcmaarkttaggaaaamc

SEQ ID NO: 15665 - DNA, 482 bp, Homo sapiens
agatctgcaaagtccgtatctccaaataagatcacatttactggcacagggagttagaattttaacatatctttttagggaacacaattcacaccacaacactggcacatgaagagggaataggaagtgtctggatkaatgtgggggagagggtattttcctcctctatagtcacttagacagaaagaatgtcatgaatcaagcccaagggcttgaaatgctccagtgcttctgtagaaaaccagcaatgcctcactcctcactccagcaggatgctttactttccctgtgatgaagaaatggagaaccagagaagttgcatgactwacacaaagtcamatagttgataagtattaggagcagatttggatcacaggttagtctgactatataaagttcatgttcttaaccactgtattcttgcacagcatttaatttgacagaacaaggcaacatgaatcattactctatttttctctata

SEQ ID NO: 15666 - DNA, 491 bp, Homo sapiens
ataataagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcaaaaaaa

SEQ ID NO: 15667 - DNA, 324 bp, Homo sapiens
  misc_feature 27,35: n=a, g, c or t
agaactacttccgggggagcggcgcgncggcgggngaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggctctgacctagacttctcacctccggagtgcccgagcccactttcctggagaacctgctacggtacgactcttcctgggagccatcttccagctcatctgtgtgctggc

SEQ ID NO: 15668 - DNA, 374 bp, Homo sapiens
  misc_feature 25,84: n=a, g, c or t
aactacttccgggggagcggcgcgncggcggggadkaagtcaaatccttcctgggaggatgaagatctgccagctctgaggagndggctgggaagaaaaagagcctcaagctttgaagcccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctggctcagccttctgagtagctgggactacagttggktctaaagagtggtgagtcagaagagacgk

SEQ ID NO: 15669 - DNA, 234 bp, Homo sapiens
agaactacttccgggggagcggcgcggcggcgcgggaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctm

SEQ ID NO: 15670 - DNA, 464 bp, Homo sapiens
  misc_feature 221..223: n=a, g, c or t
acctcggatgccgtcccgctggccgaaagcaaccaacacacgctcatcgcgtasttgagcagcagatccagcggataactgaaagttttctcagcctcagcccgtggcgcgtastgtccaactggtaaatcaagccgccagctttgttcaccacatacacactaaaaatcgccatcgctgccttgccgctcggaaactggtattcagcctctacccgacrnnncctccccggaaccgcatcacagcacttgccgccgdhvccaccccagcctcctcctcctcctcctcctcctcccgcgccccccgtgcagccacctgctgcacttgcgcactgggagcgacacgctcgggcataagtagtgccggaaagttagctgccgagacctggtggattggcttttcgtttatcagtgcaggaaaacaggcgctatagtactgcgtcacaactagcgcagactccggaa

SEQ ID NO: 15671 - DNA, 227 bp, Homo sapiens
  misc_feature 58,221: n=a, g, c or t
acctcggatgccgtcccgctggccgaaagcaaccaacacacgctcatcgcgtmsttgnagcagcagatccagcggataactgarattttctcagcctcagcccgtgggcgtagtgtccaactggtaaatmaagccgccagctttgttcaccacatacacactawaaaybgccatcgctgccttgcsgctcggaaaactggtaatcagcctctacccgtcknkcycct

SEQ ID NO: 15672 - DNA, 300 bp, Homo sapiens
cattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaakgtkggtccttksmackgkkraratyckscykrwkratwttwaaggwaaycctgctttctgagaactctatcaccagatgg

SEQ ID NO: 15673 - DNA, 560 bp, Homo sapiens
aattgggtatcgcactactggaaggggcggcgctgccatgacagagaaggcaataaaactgaaggcctagctcgactaaaagcgcttactattaaggaagacttcgctgtggctccatccggcacgaaagctaaaccgtgtaatggctggcaaccaggaagctagactacctagaatccggaggattggagggactggccggcgtgggcccctgagatctcctactacatgtcttcagttttatccatagacacggaaggacactaaaattgcctggtgccatttcctgtgaaacaagtctagataagagaagggacttgcccaaggtcacatagccgagaaataaagccgagggcagtaggagaaatgatctgactttccgaaccacccccaagcctagggcccttatcaccacacctttcatggaagtgaaaatcctgctcttgtgctctttaacccttaatgaagtttataggtcccagcaaagaaaatggatgtaagaactgggcttttttccccctctaaatgatagtaaagggcctaatgcagtgagatgtgtc

SEQ ID NO: 15674 - DNA, 493 bp, Homo sapiens
gtcttgggtggatcttgccctagtatcaatatagaacctgaaatgtgtagaaagtcctcttaggattatttttcaatagttttcattgatatgctttgtacagtgatttggacctttactggttatcatgaggatcaagaccaaaggggacatgaaaaacaaattgaagagcaaacctcaaaggcataatacaaaactgaagttcctgagattagatgtcaatgcaggtaccatcccttagattggtcctagaagttctaaggaaaggcaaaagaattaaaaaatgatcaggagatcacctgaaagaacatcaacctacattgagctgtaatgataaattgaaatataaaagctaaattgagaatgtcagagccaaattatctaagacatgataataacccagaccattgactctaaagcaaggaattatagatggatatagaagtagcaaatttaagaaaatgaaaatggcaacattagcatgtgttattgt

SEQ ID NO: 15675 - DNA, 505 bp, Homo sapiens
atagaaacccttgcctgggctccgaggtacaggcctggagctaggggacgaggactgttctcctccatggtccggaagtcttcccaggctccccctctgagcttgatggctcggcggtggatttgggctgcggcgggagattaagctagaggagcccgctagtgccaaagtcaaataaagacccggcggaggagcttcggcctgattttgttgatttgtcttcagcctggtctttgtatcagattgagactggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggaggtgcacccattcctgcagttcaaagcctggcaagactcaccatcatcttcct

SEQ ID NO: 15676 - DNA, 537 bp, Homo sapiens
atgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgrggttccgggaaggggctaggccggcttgaaaagagattatgactgtaccttttaactytgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagctgaagaggaagtatcctgtaccggcccctgctgctactgcaatgcagaggtacccgttgtaggtcatgaagatgagcatgaggaagtagcttatgaccacc

SEQ ID NO: 15677 - DNA, 163 bp, Homo sapiens
aaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccastcctcg

SEQ ID NO: 15678 - DNA, 402 bp, Homo sapiens
  misc_feature 248: n=a, g, c or t
aaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtaaccacctcagtggtcaccgtcttcaccgtggtcgcctcagcccgctcgccaccccagttgaggcgctnctggtgtcatgtctgccacaggggaccgacacccgacccaaggggaccaggaggccccggtaagccaggagggagcacaggccgaggcggcsggagctggtaaccaggagggcggcgactccagccccgrcagcagcgacgtggtgcctgcggc

SEQ ID NO: 15679 - DNA, 470 bp, Homo sapiens
tggtttacataattttgggccccagatggttaagtgctaaatttgtagggtaggctatcaggaagtgcaggctggaaacatgcaggagctgtccctgaagtccacaagtggaatttgttasttcatcatggaaacctcagttttgttcatacacctaaatacttcagtatgtctttcctaaaataaaaggcatccatttamctwaccargkttamcggwttggkgaaaatttcaactgttgttaaagcgactgatgggatcagtttcacctagattatctaaagcagtctcctttacataaagtcaatgaattgtaaatattggttgcatgtacacaattccttcaccacaacacctaagattagkatttgattgagttactgggtgctacaacctagccaagttgagtcataaaactgaccatctctggaggtgtactctgcagtaaaaagctagctgaggcattattc

SEQ ID NO: 15680 - DNA, 532 bp, Homo sapiens
gccgggaacccgcgttggcgtggttgactagtgcctcgcagcctcagcatgggggaacatggcctggagctggcttccatgatccccgccctgcgragctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattggtaagtgctgttattcatgcattcacttgccatctgttctataaaatcctccttttactgctcttctgaaatattacatgtacaggattatacttttttgggtcagctttgctataaattgaaggagcaaaatggtaatggttatttttccttcacatatccttattgttttctttttagtattgtatactag

SEQ ID NO: 15681 - DNA, 471 bp, Homo sapiens
aattagtttagcatcaaagcctacgtcttttgtgatctaaataaaattatttttattactctgtttctctaaatctgcattataaaaagctaattttcctttttattttagggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttag

SEQ ID NO: 15682 - DNA, 122 bp, Homo sapiens
agtaggacctgcctttcagtaactttcagaggcatggggagcccttccctgaaagagaggagaaggtgacatcttagaaactgtgataaaatgatctcaggacccaaaaaaaaaaaaaaaaa

SEQ ID NO: 15683 - DNA, 489 bp, Homo sapiens
tttaaaagatagacatggtgccatgaagttggggagttgggtgaattatcccattctagttacagaggagctttccttaaatgccctttaacttctaggtttagttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatatt

SEQ ID NO: 15684 - DNA, 475 bp, Homo sapiens
atcttttagtggttttcatttgacttcatgttgattttcttaattttttcgtttaatatttagtaagagtctgatattgagttttactgcactttaaagcatttcggatgttaattaaaatcttgactctagtagcacattcagtcgggtcaagcgtcactatttgacataaatggagacatctggctgtcacccaagtttgataagctgaatacccatgcagatgaggcagccgtgctagaaacaccactctattacgcctagtggcatttccctacccatattgttacaatggtgctcatgtcctatgaatttttttttcagggctgctattatttgagaagctgtgatattttaagtcacggatacgatgtgcatcactaggctcacgtggcaatgggatgatgccttagtgtcttagcccgtctgactgtcactaacactttctctccctttctcatagtttctactggag

SEQ ID NO: 15685 - DNA, 532 bp, Homo sapiens
caaggccaggctggtctcgaactccttacctcaggtgatccacccatattggccctcccaaagtgctgagattacagggtgtggagccaccatgccctggcctcaatcttttcttttaaacaattattcctatattttattgtaatgcagtttaaccgtgtttgtcagattcaatactctgtgaccccgttaaccaagtctctgtatgtttawtacygggaatttcaaagtggccgtgaccgttttcttaaatatactttatttgtttagtgcaattttaggttcacagtaaaactgagcagagggtacagagagttctcatttactccctgtccccacacatgcacagcctcccttatcaccaacactgggcaccagagtggtcatttgttacaactgatggaccttcattgacacgtcactatcaccagagtccatagtttacattagggttcactcttggggtggtacatttctataggtttggatgtattttcagtgacatgcatctaccattatagtatcatacaga

SEQ ID NO: 15686 - DNA, 471 bp, Homo sapiens
caaggccaggctggtctcgaactccttacctcaggtgatccacccatattggcctcccaaagtgctgagattacaggtgtgagccaccatgcctggcctcaatcttttcttttaaacaattattcctatattttattgtaatgcagttaaccgtgtttgtcagattcaatactctgtgacccgttaaccaagtctctgtatgtttattactgcaattcaagtggccgtgaccgttttcttaaatatactttattdrtttagtgcaattttaggttcacagtaaaactgagcagagggtacagagagttctcatttactccctgtccccacacatgcacagcctcccttatcaccaacactgggcaccagagtggtcatttgttacaactgatggaccttcattgacacgtcactatcaccagagtccatagtttacattagggttcactcttggggtggtacattctatag

SEQ ID NO: 15687 - DNA, 428 bp, Homo sapiens
gtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggc

SEQ ID NO: 15688 - DNA, 438 bp, Homo sapiens
caagatagctgacgtaccagacatgaagacgagatggtgagtgtgtctcacggtgagctccggtggcccaagtggctgtgtggccattatatgaaggtcattcttcaggctgtccccatgaaacctgagggcttccctgagcctctgtgagccttctcttcaaccaaaactgaggaatagataattagctggttgagatctttgcttttgttgttttacattgaaagtcacccatatactcgaattactgattctacaattttttggccactcaaagcaaataaaaacataagacgttggctgggcgcggtggctcatgcctgtaatcccagcactttgggaggccgagacgggcagatgacaaggtcaggagattgagaccatcctggttaacatggtgaaacccgtctctactaacaatacaaaaaaaaaaaaaaa

SEQ ID NO: 15689 - DNA, 349 bp, Homo sapiens
aaattcaagtaataagaaagcaaagaagagtttggccaaatcctctagtcgctctcatagctgaaggcacccaccggggccacttctgtccccagcgtcttctcgggtcgtgcagccatggccatgcagaaaatctttgcccgggaaatcttggactccaggggcaaccccacggtggaggtggacctgcacacggccaagggcatttccgagcagctgtgcccagtggggcttccacgggtatctatgaggctctggaactaagagacggagacaaaggccgctacctggggaaaggagtcctgaaggctgtggagaacatcaacagtactctgggccctgctctgct

SEQ ID NO: 15690 - DNA, 438 bp, Homo sapiens
aaccatccattggtcttcaccagtagttctgcagtggggatctgcacttctgggcttcagcacacatcagtgtggttcacgtgtttcctgctgttatgaaagagattggagaggactaagcttggaattgcctgtcccacagcaagaggctatggagctgggccacggagcagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcg

SEQ ID NO: 15691 - DNA, 497 bp, Homo sapiens
agtctgtagatgagggtgttttgagcctgggactgaaggtgccacaagcagtgtctatttcctagtctgtcttcactttccactccctataccagcctgatgcctcggctctctccttcacaactgtatggtcacctgtcctcagaaaactgagtgctttggcacaggggtcacctcataagaaggggtggataggccggagaacctccactaactctcccactagttttggtaatatacctgagaaacacacatgaatttagggagggcggagtctggttatggcttggaaatggagatctttgatgttttaggcaatgggtgattggtaacagaggtgcaggaaggggaccatggctgatgtggtagggtgatagggagaggccaaggtggttgtacgtatctggtctgtgtggcctcaagcttgcagatgggttgggactgtaaatgctaccttccatggaggcacattcatgctcagggagatgaatgcctgc

SEQ ID NO: 15692 - DNA, 386 bp, Homo sapiens
ctagtcgttttcaaagcgcctcgstgatttctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggtaaaagttttgtttgtgagaaacttggctactacggtgacagaagaaatattggaaaagtcattttctgaatttggaaaactcgaaagagta

SEQ ID NO: 15693 - DNA, 587 bp, Homo sapiens
ctttttccaggcggtatcctttgtgcatgcctactgtacattttcgacctctttccgatggaatgatctaagatgaaagtaaactttttaaatgtttaatcattcaccactaggcaaaccgtcataagcattacagttcgcattatttctgtagtgtctcttatgtaaaaatgctttcatttctgatcttgcaatgaagtgctgtactaactcgcattatgcatattagaaaactgataagtgatttgtccgacattattctgttaattagcgatgagccagtattgcacagcttgttttacgtaattttagatagctgcttgtaaccacttagattatatagaaattaagacatagaaacttttatcagaattaccagaaatagtagccttttgctattagcttcatgtagagatttacctgagtaaagtaccaaagaagttatctgaggtattgttgaaggatgatacagaatatattttctaaaaatcacgctgatttatgacacattactctgaaatacacatctcaagtccttaaaagaatatatgacaactgtaagaagccattttagataagtaatttga

SEQ ID NO: 15694 - DNA, 201 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgt

SEQ ID NO: 15695 - DNA, 296 bp, Homo sapiens
atgttctgsttccaccgttgtcctactttggatagcatcaagacaaaaatctcagtcttcgaggaactcacagtgtagcagaaaagacaaaggaggtaaacaggaggagcatgaataattcatcttgatgtaatcatgcargactcctaagaagatgttaggagaccctgtcatcattcttttggcctctaatgtccgttatcttcatgtttgctggcttccttttastactatggaaatasaacatatgcaaaagtagtgttttcgctgtttaaaaacatcgtcagsagcatcat

SEQ ID NO: 15696 - DNA, 525 bp, Homo sapiens
atkttctgcttccaccgttgtcctactttggatagcatcaagacaaaaatctcagtcttcgaggaactcacagtgtagcagaaaagacaaaggaggtaaacaggaggagcatgaataattcatcttgatgtaatcatgcaagactcctaagaagatgttaggagaccctgtcatcattcttttggcctctaatgtccgttatcttcatgtttgctggcttccttttactactatggaaatacaacatatgcaaaagtagtgttttcgctgtttaaaaacatcgtcagcagcatcatcatcattaactgcaccaggaagccatgactcctttctggacaaggtgcacttgcctgtcatccttccatctctttcttcctccttgaagttcacaatacccagtccaggagcattgcagagaatgctaggtgtgtctgcagacttgactttaaaagaaaacaagttccttcaagtgagttcatcatgatggggatgatatttgtttgagagaatgtgtgtctttggcaa

SEQ ID NO: 15697 - DNA, 466 bp, Homo sapiens
tactaagtatttcttctaatcttctttaccagtgcctgaaaactaaaaacaacattctggcttcagaacaactcatcctaacaaggtatagtatttcagtgctgactgataggacaagttagcacgtctaaacgactcaagaaggtcatggggtcaggcacggtggtctgtggtcccagctactcaggaggctgaagcaggaagatcgcttgatcccaggaatttgagtctagccttggcaacacagtgagaccctgtctctaaaaaattaattaatttataaaaaagtaaatcatggggatctttttccaagaagggtgggtctatcattctgtaaaggtcccattcagccctatttctgcttcaggttctttctccttcactccctttcaatccaaccctataaattagactagaaaacaaagatgctgacaaacaccaaatggtataatctgaggcacctttt

SEQ ID NO: 15698 - DNA, 284 bp, Homo sapiens
tcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctc

SEQ ID NO: 15699 - DNA, 464 bp, Homo sapiens
  misc_feature 415: n=a, g, c or t
aaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacatgttctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcaggtaaaacaaataagcagaggcacaaaaatcatcaccaaaccagactcactgnatgccaacactggcatgtgcgcagacattttctattctggacttacttc

SEQ ID NO: 15700 - DNA, 372 bp, Homo sapiens
  misc_feature 351: n=a, g, c or t
attactagaacatctaatygrrramytgttttctkraktwrtctgtgctggaggtctgctcagacgaaggtctccatggcgttagaagtcttgatgctcctcctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtrgcatcagaacaagggtagtttctgaggaaactctcctttttcaaaccngagctgtactttaccccaagg

SEQ ID NO: 15701 - DNA, 118 bp, Homo sapiens
aaataaaagctctcctgatggcctgttcctgcacatttcctgatgacgccctcgatcacaakcaggttataktacaaaacatkttttccctgsawtctcacgaactgtgaacaaaaac

SEQ ID NO: 15702 - DNA, 502 bp, Homo sapiens
agtatgcaactggctaaacagtggagaaagcttggttgttactgtgccccatctctcctctagggtagccaacaagatgtaagcagaagtcttatggtgtggcttctgggaaacctctccaaagcatcctgaatctcaacaggaatttctgattaaatgaatacaagaaggaagagagactggcacaaaatagagagaataaccagttataaagagaaatgagatttatgaccaaggcaagagaggagagtttcaagaataaagaaataagagagctaatagaagtctaggaaggactgagagaagacctctggaaaactgatcttcagagaatgatctttgcaggaaatctctgttacctgaagatgaaaaggaatgtgaaccaactctgatccmawttcagaccttcgccaactgacagttcaggtgaaggccctctggggtgaccagaaagcaagaaaagatgagtatattattgctgaacagttctctttcagaaaaa

SEQ ID NO: 15703 - DNA, 482 bp, Homo sapiens
ccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaaactaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagc

SEQ ID NO: 15704 - DNA, 503 bp, Homo sapiens
agattaagagagtcaccagggttcccttgtaacatttctcatcaaagagtgttctatagggaagagataaaacctaaacagtcccggaagctgagacaagaaactgaaaaaaaaaaaggaaagtgagcaacaagataatgtaagtcacaactgagccaattaaggagcaggagatgcagcagcatgtcccaaacaaaactgattggaggtcaagtgtggacaaccagagcaagttcttgcacagctaatgtatccccaggtgtgaactgagtaacatgaagaaaggcatcctcctgccacctcctgaatcagtagaaaaagacaaaagcttttgatgggattatgctggagtccatgtcatggaaccaaactggaaattttctggcatgattttaggcgttttgcatgaactctaattcattgaaatgtaacaaccttataaggtccctgcaggacatgtcacccaaaataatgcatcagatataaggacttgtcttttactc

SEQ ID NO: 15705 - DNA, 503 bp, Homo sapiens
agwtsyrswwkwagatctgctttttaagtgaaacgaacatgccacccctccgagggctgcggcttccccgggcttgcttctttgccgctcctctttccggctctcgcgctcactctttaattggcactggcccctaagtttgccaggagctcgctgcccgcycsgrscrgggkccssgssgggrgscgskggkksgggsrgssrgtccssgrrmcssaakycagmarcgtcktkggcmwtgwatattyywtcaaacsgactttkggtgcgkcsckyctyactgccwtcagtgcyatktscrrtkacatttctgrmttgagtgraggaawgcssgamggaaacccgggcgraattkgtwttwgrggatcttcytggcgscmmtgmtwwwtgyccykwytkaykmmsctymwsryywwsmtcwrmrwywwmatswgaaataaaatgaaagcggtgccaagcggcatagaaccgcctggccgctggkkmysaksccggggaccagg

SEQ ID NO: 15706 - DNA, 401 bp, Homo sapiens
  misc_feature 24,45: n=a, g, c or t
agatctgctttttaagtgaamkancatgccacccctccgagggsngcggcttccccgggcttgcttctttgccgctcctctttccggctctcgcgctcactctttaattggcactggcccctaagtttgccaggagctcgctgcccgctcggagcagggtccggccgggagccgctggtgggggcggggagtccgggagccgcaatccagaagcgtcgtgggccatgtatatttcatcaaacggactttgggtgcgtcgcgtctcactgccatcaggtgctatgtgcagtgacatttctgacttgagtggaggaatgcgcgaaggaaacccgggcgaaattggtattagaggatcttcttggcgccaatgctaattgtcctgatttatgcccttctgacta

SEQ ID NO: 15707 - DNA, 211 bp, Homo sapiens
agcgcacgacgtgcgcgcaccctstcccctcgwccaccgytgccgyctycttcttctgccgytcctggtgctgcttgwgtgctcgtttggygcggacctggtacctctttkgtgaagcggyagctgaggagactccggcgctcgccatggccgacgaaaagcccaaggaaggagkcaagacttagaacaacgatcatattaatttgaaggw

SEQ ID NO: 15708 - DNA, 62 bp, Homo sapiens
cttcttctgcsgctcctggtgctgcttgtgtgctcgtttkgtgcggacctggtacctctttt

SEQ ID NO: 15709 - DNA, 283 bp, Homo sapiens
tatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagcaaaaaaaaaaaaaaaa

SEQ ID NO: 15710 - DNA, 328 bp, Homo sapiens
acacctctcggtgcagattgcaaagcgccttccgttgcgagagctgcagattttgcaagagccaggctcgcccaccttgtagraaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgsscgcccctgggcagasastcgtccaaaccactggagtgtgctggtgactgg

SEQ ID NO: 15711 - DNA, 458 bp, Homo sapiens
actttcttttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtraaaaaaaaaaaaaaaaaaa

SEQ ID NO: 15712 - DNA, 497 bp, Homo sapiens
aattgatttgctgacaagagtgagtgacagtgtcagaccacagccgccttccctcacacagcctgtctgcctgtgccctgttcagccctcagggaagtctctctgttggtggcttttcatggtgcctccacctctcacctgcggctcctgtaataatgttaatgttcctctgcctgaaatgtaatgatggtcattaggtaccagcacatcacagccccagacagtgtccctggaggctggcatttttcagcagtgttaaaaatctccactcgataagtttgcatggtgctgtatgttcacagctcttagacctagactctagaagtcagctggtgactttcttctagggtttattctctcctggtggcaggtgagcccagtgatgctccattgtcatgggagtgttgggtagggggtggttgtgggagtgagagattaacaggagcattaaatgatggagttttgttttctcctcacgctctggtccctgctagact

SEQ ID NO: 15713 - DNA, 150 bp, Homo sapiens
tataattttcactaatgtggttattttatattaagcctacaacatttttcagtttgcaaatagaactaatactggtgaaaatttacctaaaaccttggttatcaaatacatctccagtacattccgttcttttttttttttttttttttt

SEQ ID NO: 15714 - DNA, 489 bp, Homo sapiens
tataaaatgaaagctgcctctgaagcactgcagactcagctgagcactgatacaaagaaagacaaacatcgtaagaagcaatagtttctctkackaatcctgagagccttatcattctacatcccatcttcctgtgagattgtctttgtagcatttaactctaattgcagttctcattttaaaaattggcttgcttattgtatattttccccaactaaagcgtgaactcctagcagggcgtggtggctcatgcctgtaatctcagcactgtggaaggccgaggtgggtcgactacctgaggttaggagttcgagaccagcctgaccaacataatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctg

SEQ ID NO: 15715 - DNA, 456 bp, Homo sapiens
atttttccgatgccaggcaccctcaaggcacagaggctggggctcatgttgggggcacttggcctctccaggcctcgaaggcttctcctgggctgatgcgagctggggaacgggagggacggacgtgggagcgagaacgtcacactggaggcagctggtggcacgatgggggacagagtgaaagagtagcaagtcaagagccttcgtgtcaccatggccacacaccccgatggcttccggcttgagggacccctggctgcagcccacagccctgggccttgcactgtgctctacgaaggccctgtccgtgggctctgccytttgccccgcgaaattccaacaccatggcggcggctgccctggctgcccccagcctgggcttcgatggggtgattsgggtgctcgtggctgataccagcctcacggacatgcacgtggtggatgtagagctgagcg

SEQ ID NO: 15716 - DNA, 222 bp, Homo sapiens
attttttccgatgccaggcaccctcaaggcacrgaggctggggctcatgttgggggcacttggcctctccaggcctcgaaggcttctcctgggctgatgcgagctggggaacgggagggacggacgtgggagcgagaacgtcacactggaggcagctggtggcacgatgggggacagagtgaaagcctcacggacatgcacgtggtggatgtagagctgagc

SEQ ID NO: 15717 - DNA, 409 bp, Homo sapiens
ggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggtgaggagcgcggccctcttgtccactctgcgggtctggtctgagggggcggasggctgcaagtggaaagggaccgggaccaacctggtaaaccattccccaagtctgagtcccccagaaccttgggctgaacccgcccctccatcgcctctaatggaagactggttagggctgcggagttaggggtggcgtagattggagatg

SEQ ID NO: 15718 - DNA, 551 bp, Homo sapiens
atatggatagttcctgatttcattcaattttcagtatacaacatacatgtatcacattttatatattatagtatgttgcctctttatcaatgacaatttgctgtatttagctagcttagccttgggaacacagggctgaggaacagtgaattactggtacagtaacatttctcataggagtctgaactttcttgggaatcaggagctgtgtatttggcatgttaagttggagatgtctactagacattcagaaagagctatcagatacaatgtgggacatgtgagcatgatgcagtcaggagctagagacgtatctcagttcaccatcagcatctaggtggtatttaacttcacaggacagcatgcaggcaccaagagagtggacgcacatacagaagacagccatgcactgagctggggacatgcaacaataacaggtaagaagatcagggccgggcatggtggttcacgcctgtaatcccagcagtttgggaggccgacgcgggcggatcacgaggtcaggagagtcagaccatcctagctaacacagt

SEQ ID NO: 15719 - DNA, 493 bp, Homo sapiens
attttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtg

SEQ ID NO: 15720 - DNA, 178 bp, Homo sapiens
actccttcctgcgagccctgaggaagccttgtgagtgcattggctggggcttggagggaagttgggctggagctggacaggagcagtgggtgcatttcaggcaggctctcctgaggtcccaggcgccasctccagctccctggctagggaaamccamcctctcagtcagcatgggggg

SEQ ID NO: 15721 - DNA, 420 bp, Homo sapiens
ataaaggagagaagtttaattgactcaccgttcagcagggctggggaggcctcagggaacttaccatcatggcagaaggtgaaggggaagcgaggcaccttcttcacaatgcagcaggaaggaaaatgaactcagaaggaactaccaaacacttaaaaaaccatcagatatcctgagaactcactcattaccatgacaacagcatggggggaaactgccgtcatgattcagttacttccacctggtttctcccatgatatgtgggcattatggggattacaacttaaggtttctggcattcttcaaagttgtgaaacaagacatattatctgtgtggatctcctacatagtggaaagttggacaaaaatgtagagaagtaaataaataaatggctatgaaagtaaaaaaaaaaaaaaatg

SEQ ID NO: 15722 - DNA, 410 bp, Homo sapiens
  misc_feature 351: n=a, g, c or t
aaaagggtgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaanttccccaaccgcctcaacctggaggccatcaactacatggcagctgacggtgacttcaa

SEQ ID NO: 15723 - DNA, 331 bp, Homo sapiens
  misc_feature 9: n=a, g, c or t
ttacctagnacatcctaatcgaaaaatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagtgagttcttccagcaaggtgcgttcatgggatactgagtgacagattagtcggtcagtggggctggagctggccgaggtggcctcatgcccamccgttaacccccagcttcgtgctgaacctgggcaaagacagcaacaasctgtggctg

SEQ ID NO: 15724 - DNA, 341 bp, Homo sapiens
  misc_feature 9..10,19: n=a, g, c or t
cacgagwsnnttacctagnacatcctaatcgaaaaatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagtgagttcttccagcaaggtgcgttcatgggatactgagtgacagattagtcggtcagtggggctggagctggccgaggtggcctcatgcccamccgttaacccccagcttcgtgctgaacctgggcaaagacagcaacaasctgtggctg

SEQ ID NO: 15725 - DNA, 364 bp, Homo sapiens
cacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttagagtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaaggtctgat

SEQ ID NO: 15726 - DNA, 340 bp, Homo sapiens
atttacgttaagttagttctttgcgamkgcgactttatagcctggccccttacagaaccaattttcctgagttgtggttcaatgcgaatctcaaggctcttactgacagcctaagaaataccccagaaagtctgcttcctacactggtcattatgtcatttaatattcttttaaaaaagtaaaacaactctcatttggcaaatgccttttagagttaacagatacagtagaaaggccataggttttgtgactagggacctggattggaatcctggctctccatacactattgacactctgtcaagtggaggaatcttatttcttaatggagatagtaagc

SEQ ID NO: 15727 - DNA, 448 bp, Homo sapiens
caacttagagtctcactcaagaaaatgaactttaacaatgttgactgaccactgtttgcattagcccttgcatatttaaggaaagtctatttttactgaatgtgtgagcatattagttgttgaatctctgactgctactatgctgagcacgagagagactcagcaaaatatttgtgtattggctgggtgcggtggctcacgcctgtaatcccagcactttgggaggccgagacgggcggatcacgaggtcaggagatcgagacggtcttggctaacacggtgaagccccgtctctactaaaaatacaaaaaaattagccgggcgtggtcgtgggcgcctgtcgtcccagcagctcgggaggctgaggcaggagaatggcgtgaacccgggargcggacttgctgtgatatcgcgccamtgcactccagcctgggtgacagagcgaggg

SEQ ID NO: 15728 - DNA, 184 bp, Homo sapiens
gcatgtgacttctggagaaaactgcagacactcgtcattgatctttccacccgtaagtgcatcgtcttcttctttccagtggtttcagagcacagtgagcaaagaggacgccatgccggaagcactgaaaagtctcatattcccgaattttgadcctttgcacaaatttcatactaattttctc

SEQ ID NO: 15729 - DNA, 471 bp, Homo sapiens
aactcctgccaggcagtgcccttcccggagcgtgccctcgccgctggtacggctcctacctggtctggaaagagctgggaggcttcacagagaaggctgtggttcccctgggcctctacactgggcagctggccctgaactgggcatggcccccatcttctttggtgcccgacaaatgggctgggccttggtggatctcctgctggtcagtggggcggcggcagcactaccgtggcctggtaccagttgagcccgctggccgcccgcctgctctacccctacctggcctggctggccttcacgaccacactcaactactgcgtatggcgggacaaccatggctggcgtgggggacggcgggctgcagagtgagtgcccggcccaccagggactgcagctgcaccagcaggtscatcacgcttgtgatgtwggtggccgtcacgctttcatgaccactgggcctgctagtct

SEQ ID NO: 15730 - DNA, 408 bp, Homo sapiens
  misc_feature 401: n=a, g, c or t
gtctttcaggaagaggagctggtgagaagacagcgaaatggcgcctccggcccccggccggcctccggcggctccggggaggtagacgagctgttcgacgtaaagaacgccttctacatcggcagctaccagcagtgcataaacgaggcgcasgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagccgtggacgtgaccaacatcaccttccctgcttnatggccg

SEQ ID NO: 15731 - DNA, 423 bp, Homo sapiens
  misc_feature 224: n=a, g, c or t
attttgctggagcctgcgaccgagtgggagtggagtggagcgctgtggttgccgactctttcctcttccccacggtccagtcagcgggttaattaggccatcggcctcgagccgagacttgtctcttatttagttctggggagcgcctcgtcgacatgagtgatgtggaggaaaacaacttcgagggcagagtgagtacaaagccgcgggagccgtctaggcgncggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataasacccctcccccttttttggaggctgactgatacctggacttctggg

SEQ ID NO: 15732 - DNA, 246 bp, Homo sapiens
aaaggattctagtccctccgggctttccgttctccaggcccggctgacagagttagccgaggccgccatattgaataagcgacccggcctcctagggggtcgtcgtggtgcagacagtttagcagaacagcctccgcggctccggggagaaggtgaggtcttgtatggatgggaagggtgaggtgsgtcggccagaggcttatttattgacgggactgtttsctttggcmcacgcgacgtagtctt

SEQ ID NO: 15733 - DNA, 396 bp, Homo sapiens
catatttttcctttcactttcggtttaaacatgctatatgtactgtatgtcctgtagcccagtgcgctccacagcatggaatctgatgtatgatatgatagaatctggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccaaaaaaaaaaaaaaa

SEQ ID NO: 15734 - DNA, 476 bp, Homo sapiens
attttgctggagcctgcgaccgagtgggagtggagtggagcgctktggttgccgactctttcctcttccccacggtccagtcagcgggttaattaggccatcggcctcgagccgagacttgtctcttatttagttctggggagcgcctcgtcgacatgagtgatgtggaggaaaacaacttcgagggcagatgagcggccgcgtctctgttggaaccggcggcgttgcgtctaaaaaggcgaaagcttgaggttgaaggtgggacgagcctaatgaagtggttagtcaacgaccgcaccgacccttaagcgttcttaagacgagagctgtgaggggaaactacgcaaggagcccttttcccttaatgtcccttcgactttcctttcacttcgaaatgaatgtggaaatgctgtcacgccttatttttctaattcctcgatgttgggttttttctcttctttatatctcaactttta

SEQ ID NO: 15735 - DNA, 397 bp, Homo sapiens
cagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcaggtcagtgcagtgcagtgcactcagtcttcgaggcgcttagcaaatgtctggttacctgcttctttgcatgtyagcttgcccctctctgaagactttcctgcttcctttctctgtgggtacactctaactgctaaatcacatwacaactga

SEQ ID NO: 15736 - DNA, 505 bp, Homo sapiens
aacattagtcaactttctctacactgcatgggaacagggttcccatgggggttatgggttgtaaggttcctctttagcctacccttacctatggcaacagtgtgggtagtgtcctgccaaacatggaataaaccctccaaataatcaacccacaasraattttacttatttttcataagtttactaatctgccatttgaagagatgtcttcagttgtgataacccaggctcaatggtttgtacaatattatgcatacttgtaggatgcatctgtatttcaggacacagattgcagaaatatctctgtcaaatataaacctcaatttgtttttcaagctgtcagtctaatagggtgatgggaaatgaatctcagacaaattagggagtctcattctcttattagcccagggscttggctagggtccagtctcaggtgtgtctttatcagcagcattaaaatggactaatatagtaaattggtaccagtagagtgaggcactgctgt

SEQ ID NO: 15737 - DNA, 271 bp, Homo sapiens
  misc_feature 43: n=a, g, c or t
attttgctggagcctgcgaccgagtgggagtggagtggagcgnctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaaaaaaaaaaaaaaaaaa

SEQ ID NO: 15738 - DNA, 494 bp, Homo sapiens
gcggtgtctcggcgcctctgcgcgcgggaagatggcggaacaggctaccaagtccgtgctgtttgtgtgtctgggtaacatttgtcgatcaacccattgcagaagcagttttcaggaaacttgtaaccgatcaaaacatctcagagaattgggtcattgacagcggtgctgtttctgactgggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggraatgactctgactttgagacggtgtaccagcagtgtgtcaggtgctgcagagcgttct

SEQ ID NO: 15739 - DNA, 423 bp, Homo sapiens
aaaaacgtgttggctattatwatcaatattagttaatttatcagtactaataaaatgagtggagtgataatcacacaaaatgattgagttggagagattagagtcaaggcagaggccaagaagcaggcggggaggaagaggacagaggatttccacaggttgctttgacgtggatcccacataccacccaggaaaggagccctaaggtcatgacatgtacatagagatgctgttttcctgttcgtaatcagtaaccacagwaccacctgaaaactgcccaggaatgtctgatgttatcacatctaaataagggattagatgtgaactttagcagagagaaactgcaggccacatttgcaagtgttttgagacatgattgtaactgtaaatgttaagggtctattaaaaagtcaacgaatcaat

SEQ ID NO: 15740 - DNA, 253 bp, Homo sapiens
ctgatgcctctggagctttttccctttatagcaccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggccggagcct

SEQ ID NO: 15741 - DNA, 259 bp, Homo sapiens
  misc_feature 43: n=a, g, c or t
attttgctggagcctgcgaccgagtgggagtggagtggagcgnctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaaaaaa

SEQ ID NO: 15742 - DNA, 323 bp, Homo sapiens
atgaactttatttgtatgtctgttttttcacatcactcacttatgactcgaagtctcatgtgtttcattgatggagctcaggttaccctgtctcagataaaaagaagattgggttagtaagttttctgagttctaacttacggacttataagagctgtttataaaaaaaggttattaaacttttgtcatatttgtagatgcttttcctcacctcccaattaaactgctgctttgatttgtttttcacataaaaatctctttcccattcagagattgtagaaatagactcttgaattttttgtatttcaaaaaaaaaaaaaaaa

SEQ ID NO: 15743 - DNA, 370 bp, Homo sapiens
aggggaagccatccgaatgccacgtgctggcatccatacagtgatttaaaacagcagaagatgaaggctaagaaatgatttcctctttctgggaacgtaggacggtgcagaaggaggagaacccccgatccccacccaaggaagcaaagttactcagaccaatcctggtgatcatggggtgacagatgttacagccttcacatctggcctcttttgtagctttggaaagcccaaggtttacacagaggtttctctgctgagccaggtacttactgtggaatttttatttattttttatttaataatttgtatttaatttggaattaaaatgaatttgcaaaagagaaaaaaaaaaaaaattgcgaaaagc

SEQ ID NO: 15744 - DNA, 380 bp, Homo sapiens
gccattaggggaagccatccgaatgccacgtgctggcatccatacagtgatttaaaacagcagaagatgaaggctaagaaatgatttcctctttctgggaacgtaggacggtgcagaaggaggagaacccccgatccccacccaaggaagcaaagttactcagaccaatcctggtgatcatggggtgacagatgttacagccttcacatctggcctcttttgtagctttgaactaacctgcctaagaagagaggaaaactgttgatgtagtgggaacgctccctcctcgagcattaaccgggttgaccccacccctctgtcctcgctgtcttcagtccaatcaagatcggaaagcaggatcaagagaaagatgatcagac

SEQ ID NO: 15745 - DNA, 503 bp, Homo sapiens
accagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgttgctctttcttctacacgcgcctgatggatagtggaacctattcatcaaaaaaagtgcactgctcttctg

SEQ ID NO: 15746 - DNA, 459 bp, Homo sapiens
aattttgcaatggcagtttcaaaacatcatgtggggaaactactagggaaaaacaaggagcagttccaggcctcacattcagaacacccagaagaaggaaggggaggcaccagctaccagaaacccttgatcataattttgctgaccactcattgaccacaattgtgtcacatggccacccctagctgcaaagaagaatggggagaatgtgactaaaaatatgctgatttcaaagactgatgtgaagattacgtgagagaattagagtgttttagagagtctccctatgttcacaccaggccggcctcaaactcctgagctcaactgatcttcccacctcagcctcccaagtagctgggactacaggtgtgtgccattgcacttgacttaaaacatttaaaatttataaaatagaaccctcatgattaaaaacaagcttatttaaaaaaaaaaaaaaaa

SEQ ID NO: 15747 - DNA, 134 bp, Homo sapiens
ccttctccccggcggttagtgctgagagtgcggagtgtgtgctccgggctcggaacacacatttattattaaaaaatccaaaaaaaatctaaaaaaatcttttaaaaaaccccaaaaaaaaaaaaaaaaaagct

SEQ ID NO: 15748 - DNA, 623 bp, Homo sapiens
aatttttcccatctttcttttcagtccttgcgcaccggggaacaaggtcgcgaaaaaaaaaaggtcttscgtgaggtgccgtccatttcatkvtgtwvctcattctctgcgcctttccgcagagcyttccaggcagcggtatgttggggccagagcatccggagggttcacaacctcatgtggtccgtaggagcctastatgaaggtagggccctgggaagaatttgcaattttcaagtggaaaacaagtggtcgttgactagctaagatgtgttttgtactttggatctgcatttgcttacaccctttccttgtagtaaggacaccaactggcttaaaacataagagatgtttcagtctcctccatttaacaggatatgaaagagcatttttaagaggtgcagcctctttgggagtggatcaaaactagaaactcatatgccatgactagatatgttttgtcaataaaacttatgacgtgaatgcttaatgcctcttttttgaaatagggaatgtaataattggccatttgcctacttttattatttgggtaacattccagtattactctctgtgatttagcttatttaatggtgttaaactgaggttatattaatttttga

SEQ ID NO: 15749 - DNA, 257 bp, Homo sapiens
attttgctggagcctgcgaccgagtgggagtggagtggagcggctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaadw

SEQ ID NO: 15750 - DNA, 98 bp, Homo sapiens
ccccttctccccggcggttagtgctgagagtgcggagtgtgtgctccgggctcggaacacacatttattattaaaaaatccaaaaaaaaaaaaaaaaa

SEQ ID NO: 15751 - DNA, 98 bp, Homo sapiens; identical to SEQ ID NO: 15750

SEQ ID NO: 15752 - DNA, 82 bp, Homo sapiens
ccccttctccccggcggttagtgctgagagtgcggagtgtgtgctccgggctcggaacacacatttattattaaaaaatcca

SEQ ID NO: 15753 - DNA, 101 bp, Homo sapiens
ccccttctccccggcggttagtgctgagagtgcggagtgtgtgctccgggctcggaacacacatttattattaaaaaatccaaaaaaaaaaaaaaaaaagc

SEQ ID NO: 15754 - DNA, 101 bp, Homo sapiens
ccccttctccccggcggttagtgctgagagtgcggagtgtgtgctccgggctcggaacacacatttattattaaaaaatmcacaaaaaaaaaaaaaaaagy

SEQ ID NO: 15755 - DNA, 86 bp, Homo sapiens
ccccttctccccggcggttagtgctgagagtgcggagwgtgtgctccgggctcggaacacacatttattattaaaaaatccaaaaa

SEQ ID NO: 15756 - DNA, 101 bp, Homo sapiens
ccccttctccccggcggttagtgctgagagtgcggagtgtgtgctccgggctcggaacacacatttattattaaaaaatccaaaaaaaaaaaaaaaaaagy

SEQ ID NO: 15757 - DNA, 98 bp, Homo sapiens; identical to SEQ ID NO: 15750

SEQ ID NO: 15758 - DNA, 100 bp, Homo sapiens
cccttctccccggcggttagtgctgagagtgcggagtgtgtgctccgggctcggaacacacatttattattaaaaaatccaaaaaaaaaaaaaaaaaagc

SEQ ID NO: 15759 - DNA, 92 bp, Homo sapiens
ccccttctccccggcggttagtgctgagagtgcggagtgtgtgctccgggctcggaacacacatttattattaaaaaatccaaaaaaaaaaa

SEQ ID NO: 15760 - DNA, 273 bp, Homo sapiens
attttgctggagcctgcgaccgagtgggagtggagtggagcggctgtggttgccgactctttcctcttccccacggtccagtcagcgggttaattaggccatcggcctcgagccgagacttgtctcttatttagttctggggagcgcctcgtcgacatgagtgatgtggaggatggtgaaccatgtatttcagtgaaatatttaatatatttaaatatcaataaaatcaaactctttgtaaaaaaaaaaaaaaaaaaaaaaaaaaaaaaaaaw

SEQ ID NO: 15761 - DNA, 98 bp, Homo sapiens; identical to SEQ ID NO: 15750

SEQ ID NO: 15762 - DNA, 98 bp, Homo sapiens
cccttctccccggcggttagtgctgagagtgcggagtgtgtgctccgggctcggaacacacatttattattaaaaaatccaaaaaaaaaaaaaaaaaa

SEQ ID NO: 15763 - DNA, 75 bp, Homo sapiens
ccccttctccccggcggttagtgctgagagtgcggagtgtgtgctccgggctcggaacacacatttattattaad

SEQ ID NO: 15764 - DNA, 101 bp, Homo sapiens; identical to SEQ ID NO: 15753

SEQ ID NO: 15765 - DNA, 99 bp, Homo sapiens
cccttctccccggcggttagtgctgagagtgcggagtgtgtgctccgggctcggaacacacatttattattaaaaaatccaaaaaaaaaaaaaaaaaag

SEQ ID NO: 15766 - DNA, 101 bp, Homo sapiens; identical to SEQ ID NO: 15753

SEQ ID NO: 15767 - DNA, 61 bp, Homo sapiens
cccttctccccggcggttagtgctgagagtgcggagtgtgtgctccgggctcggaacacac

SEQ ID NO: 15768 - DNA, 98 bp, Homo sapiens
cccctwwctccccggcggttagtgctgagagtrcggagtgtgtrctccgggctcggaasrcacatttattattaaaaaatccaaaaaaaaaaaaaaaa

SEQ ID NO: 15769 - DNA, 98 bp, Homo sapiens; identical to SEQ ID NO: 15750

SEQ ID NO: 15770 - DNA, 99 bp, Homo sapiens
cycttctccccggcggttagtgctgagagtgcggagtgtgtgctccgggctcggaacacacadttattattaaaaaatccaaaaaaaaaaaaaaaaagg

SEQ ID NO: 15771 - DNA, 97 bp, Homo sapiens
cccttctccccggcggttagtgctgagagtgcggagtgtgtgctccgggctcggaacacacatttattattaaaaaatccaaaaaaaaaaaaaaaaa

SEQ ID NO: 15772 - DNA, 101 bp, Homo sapiens
ccccttctccccggcggttagtgctgagagtgcggagtgtgtgctccgggctcggaacacacatttattattaaaaaatccaaaaaaaaaaaaaaaaaagt

SEQ ID NO: 15773 - DNA, 101 bp, Homo sapiens
ccccttctccccggcggttagtgctgagagtgcggagtgtgtgctccgggctcggaacacacatttatkattaaaaaatccaaaaaaaaaaaaaaaaargy

SEQ ID NO: 15774 - DNA, 97 bp, Homo sapiens; identical to SEQ ID NO: 15771

SEQ ID NO: 15775 - DNA, 101 bp, Homo sapiens
  misc_feature 99: n=a, g, c or t
ccccttctccccggcggttagtgctgagagtgcggagtgtgtgctccgggctcggaacacacatttattattaaaaaatccaaaaaaaaaaaaaaaaangt

SEQ ID NO: 15776 - DNA, 97 bp, Homo sapiens; identical to SEQ ID NO: 15771

SEQ ID NO: 15777 - DNA, 88 bp, Homo sapiens
ccccttctccccggcggttagtgctgagagtgcggagtgtgtgctccgggctcggaacacacatttattattaaaaaatccaaaaaaa

SEQ ID NO: 15778 - DNA, 90 bp, Homo sapiens
cccttctccccggcggttagtgctgagagtgcggagtgtgtgctccgggctcggaacacacatttattattaaaaaatccaaaaaaaaaa

SEQ ID NO: 15779 - DNA, 97 bp, Homo sapiens; identical to SEQ ID NO: 15771

SEQ ID NO: 15780 - DNA, 101 bp, Homo sapiens; identical to SEQ ID NO: 15753

SEQ ID NO: 15781 - DNA, 97 bp, Homo sapiens; identical to SEQ ID NO: 15771

SEQ ID NO: 15782 - DNA, 86 bp, Homo sapiens
ccccttctccccggcggttagtgctgagagtgcggagtgtgtgctccgggctcggaacacacatttattattaaaaaatccaaaaa

SEQ ID NO: 15783 - DNA, 98 bp, Homo sapiens; identical to SEQ ID NO: 15750

SEQ ID NO: 15784 - DNA, 51 bp, Homo sapiens
cccttctccccggcggttagtgctgagagtgcggagtgtgtgctccgggct

SEQ ID NO: 15785 - DNA, 97 bp, Homo sapiens; identical to SEQ ID NO: 15771

SEQ ID NO: 15786 - DNA, 85 bp, Homo sapiens
cccttctccccggcggttagtgctgagagtgcggagtgtgtgctccgggctcggaacacacatttattattaaaaaatccaaaaa

SEQ ID NO: 15787 - DNA, 99 bp, Homo sapiens; identical to SEQ ID NO: 15765

SEQ ID NO: 15788 - DNA, 100 bp, Homo sapiens
ccccttctccccggcggttagtgctgagagtgcggagtgtgtgctccgggctcggaacacacatttattattaaaaaatccaaaaaaaaaaaaaaaaarg

SEQ ID NO: 15789 - DNA, 97 bp, Homo sapiens
ccccttctccccggcggttagtgctgagagtgcggagtgtgtgctccgggctcggaacacacatttattattaaaaaatccaaaaaaaaaaaaaaaa

SEQ ID NO: 15790 - DNA, 97 bp, Homo sapiens; identical to SEQ ID NO: 15771

SEQ ID NO: 15791 - DNA, 483 bp, Homo sapiens
aagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcaggtgagtcgactcccacctgcaggagctggaaagcaactctgccagaggtgaacttatgctgggtgtttgggggaaacaccatggggtggagcaaaggaaacttggcctgtcacaccttctctcacctctctagaagggaagccaaaccgttggctgaggaaggaagggaggggcaagctgtgcccttctcccctgagcgcaaatattgtccttattgagaaacaaggggaggacaagagagatctgtgtcatgctggttcctgggacatgagtttgctgcctctcccatctgcaggtgtagcatggatgctcaattccatttgggccaatattcactga

SEQ ID NO: 15792 - DNA, 99 bp, Homo sapiens
ccccttctccccggcggttagtgctgagagtgcggagtgtgtgctccgggctcggaacacacatttattattaaaaaatccaaaaraaaaaaaaaaaag

SEQ ID NO: 15793 - DNA, 82 bp, Homo sapiens
  misc_feature 18..19: n=a, g, c or t
ccccttctccccggcggnnagtgctgagagtgcggagtgtgtgctccgggctcggaacacacatttattattaaaaaatcca

SEQ ID NO: 15794 - DNA, 97 bp, Homo sapiens
ccccttctccccggcggttagtgctgagagtgcggagtgtgtgctccgggctcggaacacacatttattattaaaaaatccaraaaaaaaaaaaaaa

SEQ ID NO: 15795 - DNA, 100 bp, Homo sapiens
ccccttctccccggcggttagtgctgagagtgcggagtgtgtgctccgggctcggaacacacatttattattaaaaaatccaaaaaaaaaaaaaaaaaag

SEQ ID NO: 15796 - DNA, 99 bp, Homo sapiens
ccccttctccccggcggttagtgctgagagtgcggagtgtgtgctccgggctcggaacacacatttattattaaaaaatccaaaaaaaaaaaaaaaaag

SEQ ID NO: 15797 - DNA, 97 bp, Homo sapiens
  misc_feature 35: n=a, g, c or t
cccttctccccggcggttagtgctgagagtgcgknttgtgtgctccgggctcggaacacacatttattattaaaaaatccaaaaaaaaaaaaaaaaa

SEQ ID NO: 15798 - DNA, 97 bp, Homo sapiens; identical to SEQ ID NO: 15789

SEQ ID NO: 15799 - DNA, 76 bp, Homo sapiens
cccttctccccggcggttagtgctgagagtgcggagtgtgtgctccgggctcggaacacacatttattattaaaaa

SEQ ID NO: 15800 - DNA, 97 bp, Homo sapiens; identical to SEQ ID NO: 15771

SEQ ID NO: 15801 - DNA, 101 bp, Homo sapiens
cttctccccggcggttagtsctgarastgcgragtgtgtgctccgggctcggawcacacatttattattaaaaaatccamaaaaaatctaaaaaaatcttt

SEQ ID NO: 15802 - DNA, 541 bp, Homo sapiens
cttttcgatgctccaattgttccttctttgcatgcctgtattaacatgaaaataatactaataggattgccaaaatcaactgctgccttccccagaaacagatcctgagatgaagattaatgttaaagtgatgtaatgagttgttttcctggagctgctgataccaaacttggcagaggagaaggatggcatcaatgggtttctgggtggttgcctggacaagggagttcagccttcgggagataaagcatgatatgcagcaagtgcatgtcattggccctgatgcctttcctctggacacccctgtttgaacctcaactctggttctcagaaccacaccatcagtggtaaggctggtgaagcagaaagacagagaaaggatgtttgaacacttgaacattctgcacacttgattcaggtcatgcgatccttctacctgcttgtactctatctcacatgggataacataccccatttccactcctcccccttactttttaccctgtgttttaaattgactgtaactgtgcaattacagcac

SEQ ID NO: 15803 - DNA, 98 bp, Homo sapiens; identical to SEQ ID NO: 15750

SEQ ID NO: 15804 - DNA, 97 bp, Homo sapiens
cccttctccccggcggttagtgctgagagtgcggagwgtgtgctccgggctcggaacacacatttattattaaaaaatccaaaaaaaaaaaaaaaaa

SEQ ID NO: 15805 - DNA, 98 bp, Homo sapiens; identical to SEQ ID NO: 15750

SEQ ID NO: 15806 - DNA, 102 bp, Homo sapiens
ccccttctccccggcggttagtgctgagagtgcggagtgtgtgctccgggctcggaacacacatttattattaaaaaatccacaaagaaaaaaaaaaaaagc

SEQ ID NO: 15807 - DNA, 97 bp, Homo sapiens; identical to SEQ ID NO: 15771

SEQ ID NO: 15808 - DNA, 91 bp, Homo sapiens
ccccttctccccggcggttagtgctgagagtgcggagtgtgtgctccgggctcggaacacacatttattattaaaaaatccaaaaaaaaaa

SEQ ID NO: 15809 - DNA, 98 bp, Homo sapiens; identical to SEQ ID NO: 15762

SEQ ID NO: 15810 - DNA, 98 bp, Homo sapiens; identical to SEQ ID NO: 15750

SEQ ID NO: 15811 - DNA, 97 bp, Homo sapiens; identical to SEQ ID NO: 15771

SEQ ID NO: 15812 - DNA, 98 bp, Homo sapiens; identical to SEQ ID NO: 15750

SEQ ID NO: 15813 - DNA, 101 bp, Homo sapiens; identical to SEQ ID NO: 15756

SEQ ID NO: 15814 - DNA, 97 bp, Homo sapiens; identical to SEQ ID NO: 15771

SEQ ID NO: 15815 - DNA, 100 bp, Homo sapiens
  misc_feature 99: n=a, g, c or t
cccttctccccggcggttagtgctgagagtgcggagtgtgtgctccgggctcggaacacacatttattattaaaaaatccaaaaaaaaaaaaaaaaaany

SEQ ID NO: 15816 - DNA, 100 bp, Homo sapiens
cccttctcccsggcggttagtgctgagagtgcggagtgtgtgctccgggctcggaacacacatttattattaaaaaatcmaaaaaaaaaaaaaaaaargc

SEQ ID NO: 15817 - DNA, 98 bp, Homo sapiens; identical to SEQ ID NO: 15750

SEQ ID NO: 15818 - DNA, 97 bp, Homo sapiens; identical to SEQ ID NO: 15771

SEQ ID NO: 15819 - DNA, 98 bp, Homo sapiens; identical to SEQ ID NO: 15750

SEQ ID NO: 15820 - DNA, 101 bp, Homo sapiens; identical to SEQ ID NO: 15756

SEQ ID NO: 15821 - DNA, 98 bp, Homo sapiens; identical to SEQ ID NO: 15750

SEQ ID NO: 15822 - DNA, 99 bp, Homo sapiens
ccccttctccccggcggttagtgctgagagtgcggagtgtgtgctccgggctcggaacacacatttattattaaaaaatccaaaaaaaaaaaaaaaaaa

SEQ ID NO: 15823 - DNA, 199 bp, Homo sapiens
acagatgacaactgcagcccagacgacccatggctaggataaagctggtgctgtcctagaaattgggtctccctcccagatccaggctgcctcctgcaggctgcagactctgacatccagccatctcaatattccagagaagaggatgagtgtgaagggtgggtggcgatttttaaamcaaagggttgattcagggaaa

SEQ ID NO: 15824 - DNA, 97 bp, Homo sapiens; identical to SEQ ID NO: 15771

SEQ ID NO: 15825 - DNA, 100 bp, Homo sapiens
cccttctccccggcggttagtgctgagagtgcggagtgtgtgctccgggctcggaacacacatttattattaaaaaatccaaaaaaaaaaaaaaaaargs

SEQ ID NO: 15826 - DNA, 98 bp, Homo sapiens; identical to SEQ ID NO: 15750

SEQ ID NO: 15827 - DNA, 98 bp, Homo sapiens; identical to SEQ ID NO: 15750

SEQ ID NO: 15828 - DNA, 100 bp, Homo sapiens
  misc_feature 98..99: n=a, g, c or t
cccttctccccggcggttagtgctgagagtgcggagtgtgtgctccgggctcggaacacacatttattattaaaaaatccaaaaaaaaaaaaaaaaanns

SEQ ID NO: 15829 - DNA, 99 bp, Homo sapiens; identical to SEQ ID NO: 15822

SEQ ID NO: 15830 - DNA, 98 bp, Homo sapiens; identical to SEQ ID NO: 15750

SEQ ID NO: 15831 - DNA, 98 bp, Homo sapiens; identical to SEQ ID NO: 15750

SEQ ID NO: 15832 - DNA, 97 bp, Homo sapiens; identical to SEQ ID NO: 15789

SEQ ID NO: 15833 - DNA, 98 bp, Homo sapiens; identical to SEQ ID NO: 15750

SEQ ID NO: 15834 - DNA, 80 bp, Homo sapiens
ccccttctccccggcggstagtgctgagagtgcggagtgtgtgctccgggctcggaacacacatttattattaaaaaatc

SEQ ID NO: 15835 - DNA, 101 bp, Homo sapiens
ccccttctccccggcggttagtgctgagagtgcggagtgtgtgctccgggctcggaacacacatttattattaaaaaatccaaaaaaaaaaaaaaaaaags

SEQ ID NO: 15836 - DNA, 100 bp, Homo sapiens
cccttctccccggcggttagtgctgagagtgcggagtgtgtgctccgggctcggaacacacatttattattaaaaaatccaaaaaaaaaaaaaaaaaagy

SEQ ID NO: 15837 - DNA, 97 bp, Homo sapiens
ccccttctccccggcggttagtgctgagagtgcggwgtgtgtgctccgggctcggaacacacatttattattaaaaaatccaaaaaaaaaaaaaaaa

SEQ ID NO: 15838 - DNA, 98 bp, Homo sapiens; identical to SEQ ID NO: 15750

SEQ ID NO: 15839 - DNA, 101 bp, Homo sapiens
ccccttctccccggcggttagtgctgagagtgcggagtgtgtgctccgggctcggaacacacatttattattaaaaaatccaaaaaaaaaaaaaaaaargy

SEQ ID NO: 15840 - DNA, 98 bp, Homo sapiens; identical to SEQ ID NO: 15750

SEQ ID NO: 15841 - DNA, 98 bp, Homo sapiens; identical to SEQ ID NO: 15750

SEQ ID NO: 15842 - DNA, 100 bp, Homo sapiens; identical to SEQ ID NO: 15825

SEQ ID NO: 15843 - DNA, 98 bp, Homo sapiens
  misc_feature 10: n=a, g, c or t
csccttctcnccggcggttagtgctgagagtgcggagtgtgtgctccgggctcggaacacacatttattattaaaaaatccaaaaaaaaaaaaaaaaa

SEQ ID NO: 15844 - DNA, 448 bp, Homo sapiens
acagatgacaactgcagcccagacgacccatggctaggataaagctggtgctgtcctagaaattgggtctcccctcccagatccaggctgcctcctgcaggctgcagactctgacatccagccatctcaatattccagagaagaggatgagtgtgaagggktggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaaaa

SEQ ID NO: 15845 - DNA, 100 bp, Homo sapiens
cccttctccccggcggttagtgctgagagtgcggagtgtgtgctccgggctcggaacacacatttattattaaaaaatccaaaaaaaaaaaaaaaaargt

SEQ ID NO: 15846 - DNA, 67 bp, Homo sapiens
  misc_feature 14: n=a, g, c or t
cccttstcscmggnggttagtgctgagagtgcggagtgtgtgctccgggctcggaacacacatttat

SEQ ID NO: 15847 - DNA, 98 bp, Homo sapiens; identical to SEQ ID NO: 15750

SEQ ID NO: 15848 - DNA, 99 bp, Homo sapiens; identical to SEQ ID NO: 15822

SEQ ID NO: 15849 - DNA, 101 bp, Homo sapiens; identical to SEQ ID NO: 15753

SEQ ID NO: 15850 - DNA, 98 bp, Homo sapiens; identical to SEQ ID NO: 15750

SEQ ID NO: 15851 - DNA, 66 bp, Homo sapiens
ccccttctccccggcggttagtgctgagagtgcggagtgtgtgctccgggctcggaacacacattt

SEQ ID NO: 15852 - DNA, 101 bp, Homo sapiens; identical to SEQ ID NO: 15756

SEQ ID NO: 15853 - DNA, 100 bp, Homo sapiens
cccttctccccggcggttagtgctgagagtvmggagtgtgtgctccgggctcggaacacacatttattattaaaaaatccaaaaaaaaaaaaaaaaaagc

SEQ ID NO: 15854 - DNA, 97 bp, Homo sapiens; identical to SEQ ID NO: 15771

SEQ ID NO: 15855 - DNA, 451 bp, Homo sapiens
atttcccatctttcttttcagtccttgcgcaccggggracaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggakgtttcagttcctccatttaacagatatgaagagcattttaagaggtgcagcctctggaagtggatcaaactagaactcatatgccatactagatatgtttgtcataaacttatgacgtgaaaaaaaaa

SEQ ID NO: 15856 - DNA, 97 bp, Homo sapiens; identical to SEQ ID NO: 15804

SEQ ID NO: 15857 - DNA, 97 bp, Homo sapiens; identical to SEQ ID NO: 15771

SEQ ID NO: 15858 - DNA, 97 bp, Homo sapiens; identical to SEQ ID NO: 15789

SEQ ID NO: 15859 - DNA, 101 bp, Homo sapiens; identical to SEQ ID NO: 15772

SEQ ID NO: 15860 - DNA, 98 bp, Homo sapiens; identical to SEQ ID NO: 15750

SEQ ID NO: 15861 - DNA, 75 bp, Homo sapiens
ccccttctccccggcggttagtgctgagagtgcggagtgtgtgctccgggctcggaacacacatttattattaaa

SEQ ID NO: 15862 - DNA, 98 bp, Homo sapiens; identical to SEQ ID NO: 15750

SEQ ID NO: 15863 - DNA, 97 bp, Homo sapiens; identical to SEQ ID NO: 15789

SEQ ID NO: 15864 - DNA, 97 bp, Homo sapiens; identical to SEQ ID NO: 15789

SEQ ID NO: 15865 - DNA, 96 bp, Homo sapiens
cccttctccccggcggttagtgctgagagtgcggagtgtgtgctccgggctcggaacacacatttattattaaaaaatccaaaaaaaaaaaaaaaa

SEQ ID NO: 15866 - DNA, 97 bp, Homo sapiens; identical to SEQ ID NO: 15771

SEQ ID NO: 15867 - DNA, 101 bp, Homo sapiens; identical to SEQ ID NO: 15756

SEQ ID NO: 15868 - DNA, 100 bp, Homo sapiens; identical to SEQ ID NO: 15788

SEQ ID NO: 15869 - DNA, 98 bp, Homo sapiens; identical to SEQ ID NO: 15750

SEQ ID NO: 15870 - DNA, 99 bp, Homo sapiens
cccttctccccggcggttagtgctgagagtgcggagtgtgtgctccgggctcggaacacacatttattattaaaaaatccaaaaaaaaaaaaaaaaarg

SEQ ID NO: 15871 - DNA, 99 bp, Homo sapiens; identical to SEQ ID NO: 15822

SEQ ID NO: 15872 - DNA, 98 bp, Homo sapiens; identical to SEQ ID NO: 15750

SEQ ID NO: 15873 - DNA, 98 bp, Homo sapiens; identical to SEQ ID NO: 15750

SEQ ID NO: 15874 - DNA, 83 bp, Homo sapiens
ccccttctccccggcggttagtgctgagagtgcggagtgtgtgctccgggctcggaacacacatttattattaaaaaatccaa

SEQ ID NO: 15875 - DNA, 101 bp, Homo sapiens
ccccttctccccggcggttagtgctgagagtgcggagtgtgtgctccgggctcggaacacacatttattattaaaaaatccacaaaaaaaaaaaaaaaagc

SEQ ID NO: 15876 - DNA, 98 bp, Homo sapiens; identical to SEQ ID NO: 15750

SEQ ID NO: 15877 - DNA, 84 bp, Homo sapiens
ccccttctccccggcggttagtgctgagagtgcggagtgtgtgctccgggctcggaacacacatttattattaaaaaatccaaa

SEQ ID NO: 15878 - DNA, 98 bp, Homo sapiens; identical to SEQ ID NO: 15750

SEQ ID NO: 15879 - DNA, 99 bp, Homo sapiens; identical to SEQ ID NO: 15765

SEQ ID NO: 15880 - DNA, 97 bp, Homo sapiens
cccttctcctcggcggttagtgctgagagtgcggagtgtgtgctccgggctcggaacacacatttattattaaaaaatccaaaaaaaaaaaaaaaaa

SEQ ID NO: 15881 - DNA, 97 bp, Homo sapiens
ccccttctccccggcggttagtgctgagagtgcggagtgtgtgctccgggskcggaacacacatttattattaaaaaatccaaaaaaaaaaaaaaaa

SEQ ID NO: 15882 - DNA, 98 bp, Homo sapiens; identical to SEQ ID NO: 15750

SEQ ID NO: 15883 - DNA, 99 bp, Homo sapiens; identical to SEQ ID NO: 15765

SEQ ID NO: 15884 - DNA, 98 bp, Homo sapiens; identical to SEQ ID NO: 15762

SEQ ID NO: 15885 - DNA, 127 bp, Homo sapiens
ctttcttccccggcggttagtgctgagagtgcggagtgtgtgctccgggctcggaacacacatttattattaaaaaatccaaaaaaaatctaaaaaaatcttttaaaaaaccccaaaaaaaaaaaaa

SEQ ID NO: 15886 - DNA, 98 bp, Homo sapiens
cmccttctscccggsggttagtgctgagagtgcggagtgtgtgctccgggctcggaacacacatttattattaaaaaatccaaaaaaaaaaaaaaaaa

SEQ ID NO: 15887 - DNA, 101 bp, Homo sapiens; identical to SEQ ID NO: 15835

SEQ ID NO: 15888 - DNA, 102 bp, Homo sapiens
ccccttctccccggcggttagtgctgagagtgcggagtgtgtgctccgggctcggaacacacatttattattaaaaaatccaaaaaaaaaaaaaaaaaagct

SEQ ID NO: 15889 - DNA, 104 bp, Homo sapiens
ccccttctccccggcggttagtgctgagagtgcggagtgtgtgctccgggctcggaacacacatttattattaaaaaatccaagaaakawaaaaaaaaaaagct

SEQ ID NO: 15890 - DNA, 83 bp, Homo sapiens; identical to SEQ ID NO: 15874

SEQ ID NO: 15891 - DNA, 98 bp, Homo sapiens; identical to SEQ ID NO: 15750

SEQ ID NO: 15892 - DNA, 100 bp, Homo sapiens
  misc_feature 100: n=a, g, c or t
ccccttctccccggcggttagtgctgagagtgcggagtgtgtgctccgggctcggaacacacatttattattaaaaaatccaaaaaaaaaaaaaaaaaan

SEQ ID NO: 15893 - DNA, 98 bp, Homo sapiens; identical to SEQ ID NO: 15750

SEQ ID NO: 15894 - DNA, 75 bp, Homo sapiens; identical to SEQ ID NO: 15861

SEQ ID NO: 15895 - DNA, 101 bp, Homo sapiens; identical to SEQ ID NO: 15756

SEQ ID NO: 15896 - DNA, 98 bp, Homo sapiens
ccccttctccccggcggttagtgstgagagtgcggagtgtgtgctccgggctcggaacacacatttattattaaaaaatccaaaaaaaaaaaaaaaaa

SEQ ID NO: 15897 - DNA, 52 bp, Homo sapiens
cccttctccccggcggttagtgctgagagtgcggagtgtgtgctccgggctc

SEQ ID NO: 15898 - DNA, 97 bp, Homo sapiens; identical to SEQ ID NO: 15789

SEQ ID NO: 15899 - DNA, 98 bp, Homo sapiens; identical to SEQ ID NO: 15750

SEQ ID NO: 15900 - DNA, 100 bp, Homo sapiens; identical to SEQ ID NO: 15836

SEQ ID NO: 15901 - DNA, 96 bp, Homo sapiens; identical to SEQ ID NO: 15865

SEQ ID NO: 15902 - DNA, 102 bp, Homo sapiens
ccccttctccccggcggttagtgctgagagtgcggagtgtgtgctccgggctcggaacacacatttattattaaaaaatccaaaawaarraaaaaaaaagct

SEQ ID NO: 15903 - DNA, 100 bp, Homo sapiens; identical to SEQ ID NO: 15758

SEQ ID NO: 15904 - DNA, 86 bp, Homo sapiens
ccccttctccccggcggttagtgctgagagtgcggagtgtgtgctccgggctcggaacacacatttattattaaaaaatccaaaar

SEQ ID NO: 15905 - DNA, 97 bp, Homo sapiens; identical to SEQ ID NO: 15771

SEQ ID NO: 15906 - DNA, 101 bp, Homo sapiens; identical to SEQ ID NO: 15756

SEQ ID NO: 15907 - DNA, 98 bp, Homo sapiens; identical to SEQ ID NO: 15750

SEQ ID NO: 15908 - DNA, 101 bp, Homo sapiens
ccccttcttcccggcggttagtgctgagagtgcggagtgtgtgctccgggctcggaacacacatttattattaaaaaatccaaaaaaaaaaaaaaaaaagc

SEQ ID NO: 15909 - DNA, 98 bp, Homo sapiens
ccccttcttcccggcggttagtgctgagagtgcggagtgtgtgctccgggctcggaacacacatttattattaaaaaatccaaaaaaaaaaaaaaaaa

SEQ ID NO: 15910 - DNA, 90 bp, Homo sapiens
ccccttctccccggcggttagtgctgagagtgcggagtgtgtgctccgggctcggaacacacatttattattaaaaaatccaaaaaaaaa

SEQ ID NO: 15911 - DNA, 97 bp, Homo sapiens; identical to SEQ ID NO: 15771

SEQ ID NO: 15912 - DNA, 98 bp, Homo sapiens; identical to SEQ ID NO: 15750

SEQ ID NO: 15913 - DNA, 98 bp, Homo sapiens; identical to SEQ ID NO: 15750

SEQ ID NO: 15914 - DNA, 54 bp, Homo sapiens
cccttctccccggcggttagtgctgagagtgcggagtgtgtgctccgggctcgg

SEQ ID NO: 15915 - DNA, 83 bp, Homo sapiens
ccccttctccccggcggttagtgctgagagtgcggagtgtgtgctccgggctcggaacacacatttattattaaaaaatccar

SEQ ID NO: 15916 - DNA, 101 bp, Homo sapiens; identical to SEQ ID NO: 15753

SEQ ID NO: 15917 - DNA, 83 bp, Homo sapiens
ccccttctccccggcggttagtgctgagagtrcggagtgtgtgctccgggctcggaacacacatttattattaaaaaatccaa

SEQ ID NO: 15918 - DNA, 101 bp, Homo sapiens
  misc_feature 100: n=a, g, c or t
ccccttctccccggcggttagtgctgagagtgcggagtgtgtgctccgggctcggaacacacatttattattaaaaaatccaaaaaaaaaaaaaaaaaany

SEQ ID NO: 15919 - DNA, 75 bp, Homo sapiens
ccccttctccccggcggttagtgctgagagtrcggagtgtgtgctccgggctcggaacacacatttattattaaa

SEQ ID NO: 15920 - DNA, 99 bp, Homo sapiens; identical to SEQ ID NO: 15822

SEQ ID NO: 15921 - DNA, 53 bp, Homo sapiens
cttctccccggcggttagtsctgagagtgcsgwgtgtgtgctccgggytcggr

SEQ ID NO: 15922 - DNA, 98 bp, Homo sapiens; identical to SEQ ID NO: 15750

SEQ ID NO: 15923 - DNA, 98 bp, Homo sapiens; identical to SEQ ID NO: 15762

SEQ ID NO: 15924 - DNA, 100 bp, Homo sapiens; identical to SEQ ID NO: 15758

SEQ ID NO: 15925 - DNA, 97 bp, Homo sapiens; identical to SEQ ID NO: 15771

SEQ ID NO: 15926 - DNA, 99 bp, Homo sapiens; identical to SEQ ID NO: 15822

SEQ ID NO: 15927 - DNA, 98 bp, Homo sapiens; identical to SEQ ID NO: 15750

SEQ ID NO: 15928 - DNA, 99 bp, Homo sapiens; identical to SEQ ID NO: 15765

SEQ ID NO: 15929 - DNA, 99 bp, Homo sapiens; identical to SEQ ID NO: 15822

SEQ ID NO: 15930 - DNA, 69 bp, Homo sapiens
ccccttctccccggcggttagtgctkagagtgcggastgtgtgctccgggmtcggaacacacatttatt

SEQ ID NO: 15931 - DNA, 97 bp, Homo sapiens
ccccttctccccggcggttagtgctgasagtkcggagtgtgtgctccgggctcggaacacacatttattattaaaaaatccaaaaaaaaaaaaaaaa

SEQ ID NO: 15932 - DNA, 84 bp, Homo sapiens
cccttctccccggcggttagtgctgagagtgcggagtgtgtgctccgggctcggaacacacatttattattaaaaaatccasaa

SEQ ID NO: 15933 - DNA, 97 bp, Homo sapiens
cccttctccccggcggttagtgctgagagtgcggwktgtgtgctccgggctcggaacacacatttattattaaaaaatccaaaaaaaaaaaaaaaaa

SEQ ID NO: 15934 - DNA, 98 bp, Homo sapiens; identical to SEQ ID NO: 15750

SEQ ID NO: 15935 - DNA, 81 bp, Homo sapiens
cccttctccccggcggttagtgctgagagtgcggagtgtgtgctccgggctcggaacacacatttattattaaaaaatcca

SEQ ID NO: 15936 - DNA, 97 bp, Homo sapiens
cccttctccccggcggttagtgstgagagtgcggagtgtgtgctccgggctcggaacacacatttattattaaaaaatccaaaaaaaaaaaaaaaaa

SEQ ID NO: 15937 - DNA, 98 bp, Homo sapiens; identical to SEQ ID NO: 15750

SEQ ID NO: 15938 - DNA, 82 bp, Homo sapiens; identical to SEQ ID NO: 15752

SEQ ID NO: 15939 - DNA, 100 bp, Homo sapiens
cccttctccccggcggttagtgctgagagtgcggagtgtgtgctccgggctcggaacacacatttattattaaaaaatccaaaaaaaaaaaaaaaaargy

SEQ ID NO: 15940 - DNA, 103 bp, Homo sapiens
ccccttctccccggcggttagtgctgagagtgcggagtgttgttgctccgggctcggaacacacatttattattaaaaaatccaaaaaaaaaaaaaaaaaagc

SEQ ID NO: 15941 - DNA, 98 bp, Homo sapiens; identical to SEQ ID NO: 15750

SEQ ID NO: 15942 - DNA, 100 bp, Homo sapiens; identical to SEQ ID NO: 15939

SEQ ID NO: 15943 - DNA, 98 bp, Homo sapiens; identical to SEQ ID NO: 15750

SEQ ID NO: 15944 - DNA, 99 bp, Homo sapiens
cccttctccccggcggttagtgctgagagtgcggagtgtgtgctccgggctcggaacacacatttattattaaaaaatccaaaaaaaaaaaaaaaaagg

SEQ ID NO: 15945 - DNA, 101 bp, Homo sapiens
ccccttctccccggcggttagtgctgagagtgcggagygtgtgctccgggctcggaacacacatttattattaaaaaatccaaaaaaaaaaaaaaaaaags

SEQ ID NO: 15946 - DNA, 98 bp, Homo sapiens; identical to SEQ ID NO: 15750

SEQ ID NO: 15947 - DNA, 79 bp, Homo sapiens
cccttctccccggcggttagtgctgagagtgcggagtgtgtgctccgggctcggaacacacatttattattaaaaaatc

SEQ ID NO: 15948 - DNA, 101 bp, Homo sapiens
ccccttctccccggcggttagtgctgagagtgcggagtgtgtgctccgggctcggaacacacatttattattaaaaaatccaaaaaaaaaaaaaaaaaasy

SEQ ID NO: 15949 - DNA, 101 bp, Homo sapiens; identical to SEQ ID NO: 15756

SEQ ID NO: 15950 - DNA, 97 bp, Homo sapiens; identical to SEQ ID NO: 15771

SEQ ID NO: 15951 - DNA, 98 bp, Homo sapiens; identical to SEQ ID NO: 15750

SEQ ID NO: 15952 - DNA, 81 bp, Homo sapiens; identical to SEQ ID NO: 15935

SEQ ID NO: 15953 - DNA, 98 bp, Homo sapiens; identical to SEQ ID NO: 15750

SEQ ID NO: 15954 - DNA, 97 bp, Homo sapiens; identical to SEQ ID NO: 15771

SEQ ID NO: 15955 - DNA, 100 bp, Homo sapiens; identical to SEQ ID NO: 15758

SEQ ID NO: 15956 - DNA, 386 bp, Homo sapiens
  misc_feature 103: n=a, g, c or t
aacaaggtcgtgaaaaaaaaggtcttggtgaggtgccgccatttcatctgtcctcattctctgcgcctttcgcagagcttccagcagcggtagggggggccanagcatccggagttcacaacctctgtggtccgtagagccactatgaggagggccctgggaagaatttgcsattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatctttgtc

SEQ ID NO: 15957 - DNA, 97 bp, Homo sapiens; identical to SEQ ID NO: 15771

SEQ ID NO: 15958 - DNA, 100 bp, Homo sapiens; identical to SEQ ID NO: 15758

SEQ ID NO: 15959 - DNA, 97 bp, Homo sapiens; identical to SEQ ID NO: 15789

SEQ ID NO: 15960 - DNA, 90 bp, Homo sapiens; identical to SEQ ID NO: 15910

SEQ ID NO: 15961 - DNA, 100 bp, Homo sapiens; identical to SEQ ID NO: 15836

SEQ ID NO: 15962 - DNA, 100 bp, Homo sapiens; identical to SEQ ID NO: 15836

SEQ ID NO: 15963 - DNA, 85 bp, Homo sapiens; identical to SEQ ID NO: 15786

SEQ ID NO: 15964 - DNA, 97 bp, Homo sapiens; identical to SEQ ID NO: 15771

SEQ ID NO: 15965 - DNA, 100 bp, Homo sapiens; identical to SEQ ID NO: 15795

SEQ ID NO: 15966 - DNA, 98 bp, Homo sapiens; identical to SEQ ID NO: 15750

SEQ ID NO: 15967 - DNA, 100 bp, Homo sapiens
cccttctcctcggcggttagtgctgagagtgcggagtgtgtgctccgggctcggaacacacatttattattaaaaaatccaaaaaaaaaaaaaaaaaagy

SEQ ID NO: 15968 - DNA, 108 bp, Homo sapiens
ccccttctccccggcggttagtgctgagagtgcggagtgtgtgctccgggctcggaacacacatttattattaaaaaatccaaaaaaaaaaaaaaaaaggtttttcga

SEQ ID NO: 15969 - DNA, 98 bp, Homo sapiens; identical to SEQ ID NO: 15750

SEQ ID NO: 15970 - DNA, 100 bp, Homo sapiens; identical to SEQ ID NO: 15758

SEQ ID NO: 15971 - DNA, 100 bp, Homo sapiens; identical to SEQ ID NO: 15788

SEQ ID NO: 15972 - DNA, 99 bp, Homo sapiens; identical to SEQ ID NO: 15765

SEQ ID NO: 15973 - DNA, 100 bp, Homo sapiens; identical to SEQ ID NO: 15795

SEQ ID NO: 15974 - DNA, 100 bp, Homo sapiens; identical to SEQ ID NO: 15836

SEQ ID NO: 15975 - DNA, 60 bp, Homo sapiens
ccccttctccssggcggttagtgctgagagtgcggagtgtgtgstccgggctcggaacac

SEQ ID NO: 15976 - DNA, 90 bp, Homo sapiens; identical to SEQ ID NO: 15910

SEQ ID NO: 15977 - DNA, 443 bp, Homo sapiens
  misc_feature 134: n=a, g, c or t
acagatgacaactgcagcccagacgacccatggctaggataaagctggtgctgtcctagaaattgggtctcccctcccagatccaggctgcctcctgcaggctgcagactctgacatccagccatctcaatatnccagagaagaggatgagtgtgaagggktggtggcgattttdvacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaar

SEQ ID NO: 15978 - DNA, 97 bp, Homo sapiens; identical to SEQ ID NO: 15789

SEQ ID NO: 15979 - DNA, 75 bp, Homo sapiens; identical to SEQ ID NO: 15763

SEQ ID NO: 15980 - DNA, 100 bp, Homo sapiens
cccttctccccggcggttagtgctgagagtgcggagtgtgtgctccgggctcggaacacacatttattattaaaaaatccaaaaaaaaaaaaaaaaaasy

SEQ ID NO: 15981 - DNA, 97 bp, Homo sapiens; identical to SEQ ID NO: 15789

SEQ ID NO: 15982 - DNA, 97 bp, Homo sapiens
cccttctcccsggcggttagtgctgagagtgcggagtgtgtgctccgggctcggaacacacatttattattaaaaaatcmaaaaaaaaaaaaaaaaa

SEQ ID NO: 15983 - DNA, 99 bp, Homo sapiens; identical to SEQ ID NO: 15822

SEQ ID NO: 15984 - DNA, 97 bp, Homo sapiens; identical to SEQ ID NO: 15771

SEQ ID NO: 15985 - DNA, 98 bp, Homo sapiens; identical to SEQ ID NO: 15750

SEQ ID NO: 15986 - DNA, 98 bp, Homo sapiens
acccttctcccgggsggttagtgctgagagtgcggagtgtgtgctccgggctcggaacacacatttattattaaaaaatcmaaaaaaaaaaaaaaaaa

SEQ ID NO: 15987 - DNA, 97 bp, Homo sapiens; identical to SEQ ID NO: 15789

SEQ ID NO: 15988 - DNA, 97 bp, Homo sapiens; identical to SEQ ID NO: 15771

SEQ ID NO: 15989 - DNA, 101 bp, Homo sapiens
  misc_feature 100: n=a, g, c or t
ccccttctccccggcggttagtgctgagagtgcggagtgtgtgctccgggctcggaacacacatttattattaaaaaatccaaaaaaaaaaaaaaaaaant

SEQ ID NO: 15990 - DNA, 439 bp, Homo sapiens
agtcaactattcaacatggaggcggaggtcgataagctggaactgatggtgagtgcaaagtgaaggagatctactgggtagtttatttttcccccatggcctcggaggtggggcacaatttggagtcgccggaaactccggagcggcggaggctggaccagagtcgagttccctcctcctgcaccaaagggagccgccaccgtctggtgtctaaaccgcctcgggtaaggggttacatccgggaaactcgtcagggaaatggcgggagatgctgagggtgcggggmctttggaattcsttgttcacttgmsstcacctttacaccccttacgaaastgcgscgggtgcagaccgcattctgtgtttgtaccaaaaaagatgtgaatggaamggtccctaagcgtcccaagaagggagaggtggttcamactccaagaaa

SEQ ID NO: 15991 - DNA, 390 bp, Homo sapiens
aactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggctgtcaccactgactaaagaagagaaaactgcggcagagcaattcaaatttcacatgccagatttatgaagaaatggactttgaaaggaaattctaacagagaagagcttaattccggagaaatttaggaagatgtcttgttaacccttgaatgtctagagattgggggct

SEQ ID NO: 15992 - DNA, 183 bp, Homo sapiens
tcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaa

SEQ ID NO: 15993 - DNA, 203 bp, Homo sapiens
tcaaaaacaaggcttttgctcttgaagttattaaatccactcatcaatgttggaaagcattgcttatgaagaactgtaatggaggagctataaattgcacaaacgtgcasatatctgatagccctttccgttgcactcaagaggaagcamsatcattagttgaatcggyatcatcttcaccaawrarwawmwagmmwraagct

SEQ ID NO: 15994 - DNA, 197 bp, Homo sapiens
  misc_feature 168: n=a, g, c or t
tcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcgntatcatcttcaccaaaaaaaaaaaaaaaa

SEQ ID NO: 15995 - DNA, 197 bp, Homo sapiens
tcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaaaaaaaaaaaaaaa

SEQ ID NO: 15996 - DNA, 446 bp, Homo sapiens
  misc_feature 59: n=a, g, c or t
acagatgacaactgcagcccagacgacccatggctaggataaagctggtgctgtcctangaaattgggtctcccctcccagatccaggctgcctcctgcaggctgcagactctgacatccagccatctcaatattccagagaagaggatgagtgtgaagggtggtggcgattttaaacaaggtgatcaggaagaccttgtggataacttcgggtctgagcacactccatcaggagtccccctctgtcacccgggctggagtggaatggtgcgatctcggctcactgcaacctctgcctcctgggttcacgcgattctcttgcctcagcctcccaagtagctgggattacaggcatgggattacacacatagctaatttcactgagggttttcaacagtagagtgacaagatctgaattaagttttcccaaagttaaaaaaaaaaaa

SEQ ID NO: 15997 - DNA, 197 bp, Homo sapiens; identical to SEQ ID NO: 15995

SEQ ID NO: 15998 - DNA, 197 bp, Homo sapiens
tcaaaaacaaggcttttgctcttgaagttattaaatccactcatcaatgttggaaagcattgcttatgaagaactgtaatggaggagctataaattgcacaaacgtsagatatctgatagccctttccgttgcactcaagaggaagcaagatcattagttgaatcggtatcatcttcaccaaaaaaaaaaaaaaaaa

SEQ ID NO: 15999 - DNA, 197 bp, Homo sapiens; identical to SEQ ID NO: 15995

SEQ ID NO: 16000 - DNA, 198 bp, Homo sapiens
tcaaaaacaaggcttttgctcttgaagttattaaatccactcatcaatgttggaaagcattgcttatgaagaactgtaatkggaaggasctataaatkgcacaaacgtgcagatatctgatagccctttccgttgcactcaagaggaagcaagatcattagttgaatcggtatcatcttcaccaaaaaaaaaaaaaaa

SEQ ID NO: 16001 - DNA, 197 bp, Homo sapiens; identical to SEQ ID NO: 15995

SEQ ID NO: 16002 - DNA, 377 bp, Homo sapiens
agaagcscggtcagcgcacgtgcccgcgagacctgcaaacttgtgccaccggctctgcccgtccccggggagcccgaacgccccgcagccctcacccctcacsgccagtctccagccatgggctgctttgaatgctgcatcaagtgtctgggaggagtcccctacgsvatccctggtggscacaatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgt

SEQ ID NO: 16003 - DNA, 424 bp, Homo sapiens
ttacaaatggrrrgcaaatgagagctggtgagttcaaaggaccaaccgaacattctctagctcatcaatggcagagcaaggatgagaactcagggagcaggagggaactccgtgcagtgtcgtttttactattgcgcatcaccttccttcagtgagtccttttcagaagcagcatattaatcaattcttgcctttttaattagagaaaccctgtgcaaagatgaaattaaaagattgtttctttattatatgttgaaatttttcttaaccttcaccatgaaaaaacaatgcttaaaatagcaaatatttttggtaaggtgacaaaatgctgtctagtatgaaatccttaatggcatcagtctaaaattcatagtggttgacaacttcacacgcagacccaaagagggtccactttctcagtggt

SEQ ID NO: 16004 - DNA, 498 bp, Homo sapiens
attctccatgtcaggaagaggaaattgcaagtaaaatcaagcattgaagtttttaggcagtggaaagtttggggctcttatgaataaggctgtcatgaacatttttgtataaatcttcatgtagacaaacgtttacatttttcttgggagcttgtgttcccagagaaatggaaatccttggagaatgtttgtctgcatgatatttggtacctggcgtatctaaacccaggacaaatgttcacagcacagcaatcaaaactgctcaggccactgtaaaaggggaagatgtgtgctagagctagagaaacacaactgaaaagtgacaactggagatgctgatcagtggtgcagattgatttcaaaagtgagtgagatgtcttgtgctttgcagtctcaggactaaagactacagaacgctggcttggtacctatgacttccaacaccagcattagtgccattctccaagtcaaagacagcaagttgcaaataaaattgga

SEQ ID NO: 16005 - DNA, 519 bp, Homo sapiens
agtaagaaggtgctgttccgagaaggagaaggaaaagggcttgacacgtattcactcggccccggacgtgggaagcaagccgtctggcttcggcctcacatcggtcctgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatgtttcattggcaagccacaattatgggacctaatgacagcccatatcaaggcggtgtattctttttgacaattcattttcctacagactaccccttcaaaccacctaaggttgcatttacaacaagaatttatcatccaaatattaaca

SEQ ID NO: 16006 - DNA, 125 bp, Homo sapiens
atcttgtggctgtgtcgtgcgcgtgaccccgtaggccggggaggcaccagctgccgcgcggggaggargccgaggccgcagcttgagggaggccccggcccctctgcgcctgtgtctggcagagc

SEQ ID NO: 16007 - DNA, 272 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaa

SEQ ID NO: 16008 - DNA, 359 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaah

SEQ ID NO: 16009 - DNA, 292 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaar

SEQ ID NO: 16010 - DNA, 362 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtmtatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16011 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaa

SEQ ID NO: 16012 - DNA, 329 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaar

SEQ ID NO: 16013 - DNA, 336 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaar

SEQ ID NO: 16014 - DNA, 306 bp, Homo sapiens
attacagaactgacattctcaatacgagagaatgttgtactgacgacacaagatctcagactkgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaawtaaaaaaaaaaaaaa

SEQ ID NO: 16015 - DNA, 339 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaawwwaaaaaaaaaaaaaaaaaaaaaaaaaaaaaaaaaaaaaaaaaaaaaaaaaaaaaaaw

SEQ ID NO: 16016 - DNA, 282 bp, Homo sapiens
attacagarctgacattctcaatacgagagaatgttgtactgacgacacaagatctcagacttgtgtgattctagcagctgaacacaccccaggctcttctgactggcagtggctctggaagcagtctggkstatagatgagctggtataactccgaagtatggaatttgctgttgtctgtgacccagcaaataaaaatagaaaaataattcgatagaaaaataatagaaatagaaaaaatttaaaaaacaaaccaagcctcattctatgamaaaaaaaaam

SEQ ID NO: 16017 - DNA, 302 bp, Homo sapiens
  misc_feature 281: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaanmmaaaaaaaaaaaaaaaaaww

SEQ ID NO: 16018 - DNA, 327 bp, Homo sapiens
attacagaactgacattctcaatacgagagaatgttgtactgacgacacaagatctcagacttgtgtgattctagcagctgaacacaccccaggctcttctgactggcagtggctctggaagcagtctgbwctatagatgagctggtataactccgaagtatggaatttgctgttgtctgtgacccagcarwtaaaaatagaaaaataattcgatagaaaaataatagaaatagaaaaaatttaaaaaacaaaccaagcctcattctatgaaaaaaaaaarraaaaaaraaaaaaaaaaaaaaaaaaaaaaaaaaaaaaaaaaaaaa

SEQ ID NO: 16019 - DNA, 359 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16020 - DNA, 305 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtcwatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaw

SEQ ID NO: 16021 - DNA, 296 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaw

SEQ ID NO: 16022 - DNA, 297 bp, Homo sapiens
attacagractgacattctcaatacgagagaatgttgtactgacgacacaagakctcagacttgtgtgattctagcagctgaacacaccccaggctcttctgactggcagtggctctggaagcagtctgvwctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaah

SEQ ID NO: 16023 - DNA, 279 bp, Homo sapiens
  misc_feature 279: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaakraaaatagaaaaataattcgatagaaaaataatagaaatagaaaaaatttaaaaaacaaaccaagcctcattctatgaaaaaaaan

SEQ ID NO: 16024 - DNA, 326 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaw

SEQ ID NO: 16025 - DNA, 458 bp, Homo sapiens
ttctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatchggaggttcacaacctctgtggtccgtagagccactatgaggagggccctgggaagaatttgccattttcagtggaaaacaagtggtcgttactagctaagatgtgtttgtactttggatctgcatttgctacacbmttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaa

SEQ ID NO: 16026 - DNA, 347 bp, Homo sapiens
  misc_feature 347: n=a, g, c or t
attacagaactgacattctcaatacgagagaatgttgtactgacgacacaagatctcagacttgtgtgattctagcagctgaacacaccccaggctcttctgactggcagtggctctggaagcagtctggkctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaan

SEQ ID NO: 16027 - DNA, 324 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtcwatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaammaaaaaaaaaaaaaaaarraaaaaaaaaaaaaaaaaaaaaaa

SEQ ID NO: 16028 - DNA, 315 bp, Homo sapiens
  misc_feature 282..283: n=a, g, c or t
attacagaactgacattctcaatacgagagaatgttgtactgacgacacaagatctcagacttgtgtgattctagcagctgaacacaccccaggctcttctgactggcagtggctctggaagcagtctggtcwatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaarrradkkdnnkaaaaaaaaaaaaaaaaaaaaaaaaaaaaaar

SEQ ID NO: 16029 - DNA, 282 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaam

SEQ ID NO: 16030 - DNA, 307 bp, Homo sapiens
attacagaactgacattctcaatacgagagaatgttgtactgacgacacaagrtctcagacttgtgtgattctagcagctgaacacaccccaggctcttctgactggcagtggctctggaagcagtctggwctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaawdtaaaaaaaaaaaaaaaaaaaaaaaaar

SEQ ID NO: 16031 - DNA, 332 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtstatagatgagctggtataactccgaagtatggaatttgctgttgtctgtgacccagcaaatgraaatagaaaaaataatttcgatagaaaataaatagaaatagaaaaaawttaaaaaacaaaccmaagcctcattctatgaaaaaaaaaaaaaaaaaaaaaaaaaaaaaaaaaaaaaaaaaaaaaaaaaaaaaaaaaad

SEQ ID NO: 16032 - DNA, 333 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtcymtagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaw

SEQ ID NO: 16033 - DNA, 297 bp, Homo sapiens
attacagaactgacattctcaatacgagagaatgttgtactgacgacacaagatctcagacttgtgtgattctagcagctgaacacaccccaggctcttctgactggcagtggctctggaagcagtctggkctatagatgagctggtataactccgaagtatggaatttgctgttgtctgtgacccagcaarkaaaaatagaaaaataattcgatagaaaaataatagaaatagaaaaaatttaaaaaacaaaccaagcctcattctatgaaaaaaaaaaaaaaaaaaaaaaaaaar

SEQ ID NO: 16034 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacawwccaagcctcattctatgaaaaaaaaaar

SEQ ID NO: 16035 - DNA, 306 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtmtatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaad

SEQ ID NO: 16036 - DNA, 526 bp, Homo sapiens
tttgataagcctattgaatcttgggttaatgtctcttaccaattttggaaaattggctattatccatcaaaataatattgctcctatcccattctcacccttctcctgggattccaatacacgttagacagttggatcagtaccatatggccctcttctctctgtctctgtctctctctgtgcatgtgtgtatgtgggtgtgtgtgtttgtgtacttttaattctatcttttctctgtgctttattttggataatttctatggacctgtctgaaacttcatcaatcctttttgctactatatgtttagtctgctcttaagcccatccaatgagttcttaatttcaggtattatattaattggttaatataataaacacttatttttattatttattttatttttaataacaaataatgagcacctactttcatagctttcatctctctgttgaaattctccatcttttcatccattttgttcatccattcctccawctcawttcatgtatttacaagaatattgta

SEQ ID NO: 16037 - DNA, 279 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaav

SEQ ID NO: 16038 - DNA, 335 bp, Homo sapiens
  misc_feature 281: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaamynvmmaaaaaaaaaaaaaaaaaaaaaaaaaaaaaaaaaaaaaaaaaaaaaaaaaaa

SEQ ID NO: 16039 - DNA, 276 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaar

SEQ ID NO: 16040 - DNA, 318 bp, Homo sapiens
  misc_feature 318: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaammmaaaaaaaaaaaaaaaaaaaaaaaaaaaaaaaaaan

SEQ ID NO: 16041 - DNA, 338 bp, Homo sapiens
  misc_feature 135,197: n=a, g, c or t
ccrttacagaactgacattctcaatacgagagaatgttgtactgacgacacaagatctcagacttgtgtgattctagcagctgaacacaccccaggctcttctgactggcagtggctctggaagcagtctggtcnatagatgagctggtataactccgaagtatggaatttgctgttgtctgtgacccagcaaatanaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaar

SEQ ID NO: 16042 - DNA, 365 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16043 - DNA, 280 bp, Homo sapiens
attacagaactgacattctcaatacgagagaatgttgtactgacgacacaagatctcagacttgtgtgaktctagcagctgaacacaccccaggctcttctgactggcagtggctctggaagcagtctggwmtatagatgagctggtataactccgaagwatggaatttgctgttgtctgtgacccagcaaataaaaatagaamaataattcgatagamaaataatagaaatagaaaaaatttaaaaaacaaaccaagcctcattctatgaaaaaaaaad

SEQ ID NO: 16044 - DNA, 334 bp, Homo sapiens
  misc_feature 334: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaan

SEQ ID NO: 16045 - DNA, 333 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtstatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaar

SEQ ID NO: 16046 - DNA, 280 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaav

SEQ ID NO: 16047 - DNA, 175 bp, Homo sapiens
tggtatcaggtaggggtccacgtcctttttgtttttagcaagttgagtttgagatacctgcaggacattgaagtaggaggataataaaaccttgtataaaggagagtaagatgttgctggtagggaaagtgtctggaaagmttttttttttttyccggagasggagcstcgctct

SEQ ID NO: 16048 - DNA, 371 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaaggtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaammaaaaaaaaaaaaaaaaaaaaaaaaaaaaaaaaaaaaaaaaaaaaaaaaaaar

SEQ ID NO: 16049 - DNA, 296 bp, Homo sapiens; identical to SEQ ID NO: 16021

SEQ ID NO: 16050 - DNA, 332 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaatrraaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaa

SEQ ID NO: 16051 - DNA, 336 bp, Homo sapiens
attacagaactgacattctcaatacgagagaatgttgtactgacgacacaagatctcagacttgtgtgattctagcagctgaacacaccccaggctcttctgactggcagtggctctggaagcagtctggwmtatagatgagctggtataactccgaagtatggaatttgctgttgtctgtgacccagcagataaaaatagaaaaataattcgatagaaaaataatagaaatagaaaaaatttaaaaaacaaaccaagcctcattctatgaaaaaaaaaaaaaaaaaaaaaaaarrraaaaaaaaaaaaaaraaaaaaaaaaaaaaaaaaaaaaar

SEQ ID NO: 16052 - DNA, 329 bp, Homo sapiens
  misc_feature 279,281..282: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaraanrnnmaaaaaaaaaaaaaaaaaaaaaaaaaaaaaaaaaaaaaaaaaaaaaa

SEQ ID NO: 16053 - DNA, 332 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaa

SEQ ID NO: 16054 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaab

SEQ ID NO: 16055 - DNA, 319 bp, Homo sapiens
  misc_feature 282: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaagrsnaaaaaaaaaaaaaaaaaaaaaaaaaaaaaaaaaaaaw

SEQ ID NO: 16056 - DNA, 320 bp, Homo sapiens
  misc_feature 283..287: n=a, g, c or t
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaakcnnnnnaaaaaaaaaaaaaaaraaaaaaaaaaaaaaaar

SEQ ID NO: 16057 - DNA, 306 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaraaaaaaaaaaaaaaaaaaaaaaaaw

SEQ ID NO: 16058 - DNA, 357 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaaaaaaaaaaaaaaaaaaaaaaaaw

SEQ ID NO: 16059 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggtataactccgaagtatggaatttgctgttgtctgtgacccagcaaataaaaatagaaaaataattcgatagaaaaataatagaaatagaaaaaatttaaaaaacaaaccaagcctcattctatgaaaaaaaaaar

SEQ ID NO: 16060 - DNA, 281 bp, Homo sapiens
attacagaactgacattctcaatacgagagaatgttgtactgacgacacaagatctcagacttgtgtgattctagcagctgaacacaccccaggctcttctgactggcagtggctctggaagcagtctggtctatagatgagctggkrtaactccgaaggtatggaatttgctgttgtctgtgacccagcaaatrraaatagaaaaataattcgatagaaaaataatagaaatagaaaaaatttaaaaaacaaaccaagcctcattctatgaaaaaaaaar

SEQ ID NO: 16061 - DNA, 335 bp, Homo sapiens
  misc_feature 194: n=a, g, c or t
attacagaactgacattctcaatacgagagaatgttgtactgacgacacaagatctcagacttgtgtgattctagcagctgaacacaccccaggctcttctgactggcagtggctctggaagcagtctggtmwatagatgagctggtataactccgaagtatggaatttgctgttgtctgtgacccagcaaatnaaaatagaaaaataattcgatagaaaaataatagaaatagaaaaaatttaaaaaacaaaccaagcctcattctatgaaaaaaaaaaaaaaaaaaaaaaaaaaaaaaaaaaaaaaaaaaaaaaaaaaaaaaaaaaaaaaaar

SEQ ID NO: 16062 - DNA, 110 bp, Homo sapiens
aagctctgaatatctgaacacacggaggtccctggagggtgccacaaccagggagggcatgagagctccacaccccttccccatgccttgccctgtgcatctcttccacc

SEQ ID NO: 16063 - DNA, 447 bp, Homo sapiens
acctacagattaagtgaaagacaaacagtagaaaaatgtggaaaaactcaaacaggtgcttctaatatggaaaaacacaaacgattggcaacatataaataggctcaagctcattagtaatcaaagaaatgcacattgaaaccacagtgttatattattttatgccttcagacaggcaaattttttaagtctaacaatatcaagtgatttgcaaggatatggtgcatctgggacaactgtaaactgcaggtgggagtaaaaactggtgcaaacactctgaaaaacaatttgagattatctagttaagttgaaggtgtacagtcctataaccagaaattcctcatcaaggtagaaactccctagagaaattgtagcatatgtgtatcaggagcgttgtgccagagtgttcatagcaacactctctgtactagaaaaaaaaaaaaaaaa

SEQ ID NO: 16064 - DNA, 450 bp, Homo sapiens
ttaaggaatgaaagataagtttagatgaaagggaagaggccaatggaggacgagttggactttattctgtagaaaatggggaacaactgaaggtgtcagtttttttttttttaagtaacatttattgtgggatttttttaattgtaaaagcaaatatgttaattgtgctgcatttggaaagcacagaaaagtataaaagaatataattacccataatttcaccaaccagcaataacaactattggcaccttactgttaactgcctgcaagttgatgccagttttcaccttctcaagcctattttgacagctctattgaaaactggaaccatatcgactgctcttcatactccctttctgctttatttttkcctccataatatttatttcctccttagaaccttaatgtgaaaaaaaaatttcctccwaatgtatgatccattgggtaagc

SEQ ID NO: 16065 - DNA, 227 bp, Homo sapiens
caacctcttcaacacagcctttgggctgctggggatggggcccgagggtcagcccctgggcagaagggtggccagtgggccagccctggggaggggatatccccccagtctgctcaggcccctcaagctcctggagacaaccacgtggtgcctgtactgcgctaactcctgattaatacaatggaagtttctgggcatttacaattccaaaaaaaaaaaaaaaaagg

SEQ ID NO: 16066 - DNA, 405 bp, Homo sapiens
agataaaagctctggagttttctcaaaaacacacatccacctacatgtaaaatttggcatccaatttcagagcatccatgattcctcaaagacaatcttgaccaacaaccttacttagatcactaaagtacctcggatcagatttcaaatcagcctactcatcaggtccactctaccatgccagaccaggcatccaagttataaagatgagattccaaattacccagctgccataaagctcgcgttcccgtgtgaatcctgaactctggctgacgacatctggagtccactgcaatcatgtgttccctcaatgactgaaaaacctgagcataatgactacctaagattcatatctgtacatacccaaaatgtttattaaatagaaataaagataaaataatgtgt

SEQ ID NO: 16067 - DNA, 516 bp, Homo sapiens
  misc_feature 501: n=a, g, c or t
agcctggdccgctgcgcagaggcgcggcgctgtacaactcggccgttgtcaccatgccggtcgtccggaagattttccgtcgccgccggggcgaytcggagtcagaggaagatgagcaggactcagaggaggttcgattaaaactggaagagaccagagargtacagaacttgaggaagaggcccaacgggtgagtgctgtggccttgctggtgggagagaaggtacaagaggagaccactctagtgatgatccctttcagatgaagacaggtggtatggtggatatgaagaaactgaaggaaaggggcaaagataagatcagtgaggaggaggacctgcacctggggacatcgttttctgcagaaaccaaccgaagratgaggatgcagacatgatgaagtacattgagacagagctaaagamgaggaaagggatcgtggacatgaggaacagaaagttaagccaaagaatgcagaggactgtctttatgaacttccagnaaaacatccgtgttt

SEQ ID NO: 16068 - DNA, 234 bp, Homo sapiens
tatcaatatcagttctttacctgtgcataaaagaatatcatgaagtaattgaacttatctgttgatataaaaacacagatccaattcgtgtctgtggatgctgcaaggactggctcattggagccaaaccatgtggcggaaactcctgaaattggtggaaaaagtggaatatggcagattgggtaggtaggagaacaattttggagattttgtttccaaaaaaaaaaaaaaaaa

SEQ ID NO: 16069 - DNA, 404 bp, Homo sapiens
gacaattattctgcaatcttcctggtcctgccattaatttatttaagtcctggaagaatacttaaattggtctcaagttccatcagcaagatgggacgactccattgaaaagaaacataatatatggaaaaattactagaaaatctaggaaaactgactgaatgctttggaaagacacagtcaagacttttaccactgaaattttcaaacaaccatcacggtatttatctcatttacttaataaataccacaatccaattcaaatactgctgaagagataatataattttgtctttaccattcttgttcasaaattgcagaaatttctctgtgcatttcaagacgtgaccacaccttccctatccctgtcccaacaggtcatgagacccccctcaygtttctta

SEQ ID NO: 16070 - DNA, 399 bp, Homo sapiens
aattattctgcaatcttcctggtcctgccattaatttatttaagtcctggaagaatacttaaattggtctcaagttccatcagcaagatgggacgactccattgaaaagaaacataatatatggaaaaattactagaaaatctaggaaaactgactgaatgctttggaaagacacagtcaagattaaaaaaaatgtgtcacaagaaagtttacagaacctactcaaactcaaagagaaatcagagactaaattctcaaaactggaagctccctacagcatccacactcttcagccttgtactatgtgatgtgtattacgaatggagccaccggcagtatttgtatgaacatgagacaatgtgtggcagatgcttggtgctttgtaatatttagtaaaat

SEQ ID NO: 16071 - DNA, 482 bp, Homo sapiens
tcaatgttaaatatgaggtgaccgtacagtagttaggagtttctttacttacaaaatcactggaaatgattaaattgcttttccccctccccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttcattttgtctcttgtttactatagcttcttaaagttaagccttgtactacaggttgttggagtactcctagatcactgtttcatagtagccagcaataagtagtgcaagtcaacaaaaacacagcaaacttaggcaaagtgtcctttctttgagattcgagttctttcatgaggtt

SEQ ID NO: 16072 - DNA, 498 bp, Homo sapiens
cttttttttgacaagatggcggcaggaggcagtggcgttggtgggaagcgcactcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgc

SEQ ID NO: 16073 - DNA, 500 bp, Homo sapiens
ataacggccgccatcttaacagcgcgttcccgttggcgtctgaggaacagcatctctgccttcctgttcacggtgaccttcgcttggtgtcctcctggcctcagcaacctgacaattctgtcgtgtcccggtgagcacttcatgcacttgttctggctgtgggtgtcgggtcttgaagtttaagttgtgtcgaggtggaaagaaaccttttcaggtggttgttcgagagcacatggatctgataccatcgaatgcatgagtggatgaatgcacataactgtaaaatttaccaccaaggaaaaacacaggactactcaactgtggttccaggccatcaccagatctcactctagcgccctgtagattcccccagaggttcaaaacgagggcatccccaggaacacggtgcgggctgatttactagcaggagggattgaattgataatgaatgcgaagataacttttgacaggtgggttttctaccagttactcatttgaaa

SEQ ID NO: 16074 - DNA, 276 bp, Homo sapiens
attgattagcatgtatataaagtaaaagtgtgaaatggatataatttcaggctttaacacatattaagacagatttgggattatcatacctagtggattatactatttaaagatagatcatttgttaagaatatggggtaggctgggtgcagtggtcacagctgtaattccagcacttcgggaggctaaggtgggcagatcgcttgaacccaggagttaaaggccagcctgggcaacatggtgaaacctgtctctacaaaaaaaaaaaaagggaaa

SEQ ID NO: 16075 - DNA, 470 bp, Homo sapiens
ttcactagctgtaaaaccttcccctagattttagtagggagttggtttctgttaatatctttgggtgttgtggcggtaaatgctacattataaacagtggcatgtatttacagttagagtatcgtgtgtgcactttttaatggtaaacttaagctgaatgtgtaatggatttgtctatagttttacatatttggaagcattttaaaataggttttaatcttacataaaattacttttatacttgtgttaacattttcttctgtgccttttgggtaatttaatttctgttatgaatttctggtgcctatgagctagctatcacctacccgaaaggtgcttagaggtgaaggtactgtttctaaaaacacatcactgtgacacctttctatcctcacattttcaagcttgcctcttttctgttctttgtggatataacgtaagtaattgtgttattcataaagatttagaaa

SEQ ID NO: 16076 - DNA, 328 bp, Homo sapiens
  misc_feature 201: n=a, g, c or t
acgtacggcagggcggggtcggcccgcagtggccagctgggagctacgagcgcggacttgcgcagaagacccccatcagggtgcggggtgcagttgcggctccagggccatggcggaggagcagggccgggaacgggactcggttcccaagccgtcggtgctgttcctccacccagacccgcgcgcctgcagcgcagsgcncgcgtccaacaccagccgcccagcgccaggtgctcttgccttttcccactgagagaaggctgctcttttgtactgccccccgctcattaaacagcctccccctaaaaaaaaaaaaaattgcgaaaag

SEQ ID NO: 16077 - DNA, 191 bp, Homo sapiens
acgtacggcagggcggggtcggcccgcagtggcagctgggagctacgagcgcggasttgcgcagaagacccccatcagggtgcggggtgcagttgcggctccagggccatggcggaggagcagggccgggaacggactcggttcccaagccgtcggtgctgttcctccacccagacctgggcgcctgcagc

SEQ ID NO: 16078 - DNA, 357 bp, Homo sapiens
aagtgaaatgaagcgtgaataactgcctaattagtggacatgaaaactggacagtctccaaagtcatcagagatgaccacgcttgccaggcaacttactagactaagggcacacaatgagcctcacgtaagcatcaggtactacatttaggaagagagatggtgtgaggatgcagtggccagaagaggcagcccagggaagatctgaggtgaaccctctggttggaaagccttggcaaattggaggaatgaaaagaaaaaagagtaaatctacaacaaggatcagcaaactccagtctacaggccaaatccagcctgctgcctgtttatgtcaataaagttttattggaacataaaa

SEQ ID NO: 16079 - DNA, 430 bp, Homo sapiens
aagactttttgacttgataagtgataactataaagcaatgatttatttttgcattttatttggaatcatacagaacttagaataaacaagtatgtcttacaaagaagtcatctcattcagaatttttatcaatttgtaatacatagtttaaaaagtcaaatagctgggcacggtggctcacgcctgtaatcccaacagtttgggaggctgaggcggacggaccacctgaggtcaggagttcgaaactggccaacatggtgaaacccatctctactaaaagtacaaaaattagctgggcgtgatggcgggcacctgtaatcccagctactcaggaggctgaggctgagacaggwgaatcaccacttgaacccaggaggcagaggttgcagtgagctgagatcatgccactgcactccagcctcggtgacag

SEQ ID NO: 16080 - DNA, 265 bp, Homo sapiens
ttcttcatggtattttcaaactttggataaatttacagattagaaagatatctgacagttaatctctgttctccttacaaattccttttgtgctgctggaaaggatctttggctaggtggatgactagttttattcaaagccttttctcaaaagccctttcagttacaaccaccccactatggaatcagtattagttawwmcatttgtataagaacctgtattttgaaaaacacattcatgtatatttattcctggaattatttg

SEQ ID NO: 16081 - DNA, 415 bp, Homo sapiens
ttcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttttaaaaaaaaaagaaaaaaaaaaaaaaw

SEQ ID NO: 16082 - DNA, 415 bp, Homo sapiens
ttcttcatggtattttcaaactttggataaatttacagattagaaagatatctgacagttaatctctgttctccttacaaattccttttgtgctgctggaaaggatctttggctagrtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttttaaaaaaaaaagaaaaaaaaaaaaaaw

SEQ ID NO: 16083 - DNA, 215 bp, Homo sapiens
cataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgag

SEQ ID NO: 16084 - DNA, 52 bp, Homo sapiens
attcgcctccaagtcgccgaagagcgaacaccccaaacaatcccgaagcgcc

SEQ ID NO: 16085 - DNA, 388 bp, Homo sapiens
aacctcttccgtcggctgaattgcggccgtatgcgcggctctgtggagtgcacctggggttgggggcactgtgcccccagcccmctgctcctttggactctacttctgtttgcagccccatttggcctgctgggggagaagacccgccagtgtctctggaggtcatccctaactggctgggccccctgcagaacctgcttcatatacgggcagtgggcaccaattccacactgcactatgtgtggagcarcctggggcctctggcagtggtaatggtggccaccaacaccccccacagcaccctagcgtcaactggagcctcctgctatcccctgagcccgatggggcctgatggtgctcctaaggacagcattcagttttcttctgc

SEQ ID NO: 16086 - DNA, 376 bp, Homo sapiens
cctgagaaagtggaagtaccagagtccttgagcaaagtcttaactcaaaactggcacatgatcgatcactccacagtgtcctatagaccacaaattccacagggtgcagacagtcaagggaatggggacatggataccaaatcttaatagacgtaaagtcatattttgcaagtgtgtgaatgaggaaggagagataatcaggactgtatctgcagcctaccacagaccctcccagccctctttgccaaggctgaggatatttatcacgccccctggtaatcccccaaccctctcctgtggggcaaagagccttgcatcattccttcccccatggggktgggggttgactttgaagagaccaaaaaaaaaaaaaaaa

SEQ ID NO: 16087 - DNA, 499 bp, Homo sapiens
agtctcacagggaataggcagtggatgagtctgaagccacgcccttctgggttccttctactccaccatgctgttcgagatatttgcaagggtcactgtagaccacaagacttctaaaatgcatttctcactttgctatttgtctggaacccctggtgaatgctggaatagagcacctggcttgaggttgagctggggtttgggcatatagttctgctacttccttggcctctcagaatctcagaatctgctcattcttccagtagtgaagatcagagaataaggggtrgggatagagtgaaaactgggctggccgggcttgaaatgcatctctaccacttggcagctctgcgatcccatgattccaagagtctcaaggttagagaagtcgcctagtccacctcccctctctgcttctcacagaagggtctgctgaacactctggtgacagagaactcacccaacatgttccatggcagaggcttttcattagatcaag

SEQ ID NO: 16088 - DNA, 422 bp, Homo sapiens
tttttaacttaaagtgtaaagagtaacattttatcttatgtcaattaaagttacatttttcatttgttggtgtacatgtgctacctgttttatggggaatgtttaacacgatcctccaagttggttctatgcataaccattcaccaaatactgctgctgtgattccttgaaggaaatattctgtggtctgctatgatgcattgccatcttgctgcttgacaataggtttataaataattagaattacgtgttttaatagtacctttgtatatataacaagatgtaaaattaaagatgaggaatgtgtgtaaatgatcattcactgtttttgttttaaaactggtcagtactatgaagcttctgtggtttgtatgatgttttaactttcactttaaactgcatagaataaattaaattgaaaa

SEQ ID NO: 16089 - DNA, 529 bp, Homo sapiens
aaaacgtccaatgtgagtgtgcctgtgcaagcccctggctgtttatactccggaggtgtccccgtgcgtcatcggtggagtggaccaaaactggtgatctgtttgccctgtgtgaccttgcccagaaccctgctgactgagagaacacatctgctggaagtcctctgggattcaaggtacaggggtaagcatgaccttgaatgcagtagcaatgtgctttagccaactaagctggctcatttcatttaccgctctatctcccatggttaagcattaaaaatacatgttgtggctgggcatggtggctcacgcctgtaatcccagcactttgggaggctgaggctggcagattgcctgaggtcaggagttcgagaccagcctggccaacatggtgaaattctgtctctactgaaaatacaaaaattagccgggcatggtggtgcacgcctgtggtcttagctactgggaggactgaggcgggaggaacgcttgaacccgggagcagaggttgcagtgagctgagattgtg

SEQ ID NO: 16090 - DNA, 165 bp, Homo sapiens
  misc_feature 3,22: n=a, g, c or t
aanaaaggatgtgacgtgaganaaccagctcggctgttagcaactctgttagcaaagctgtttgtctttctcggaaacaacattaacgataagcctctttgaatatggaggccgctgcatacggcccggctgagacccaaagcccggtggaaaaagacagcccgg

SEQ ID NO: 16091 - DNA, 302 bp, Homo sapiens
tgccacgccgtgtcagtcgggagggagggagcgagcaggcgagggggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaaaaaaaaaaaagg

SEQ ID NO: 16092 - DNA, 270 bp, Homo sapiens
  misc_feature 16: n=a, g, c or t
agagcgagcaggcgangaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaawaaaaaaaaaaaa

SEQ ID NO: 16093 - DNA, 454 bp, Homo sapiens
atttcccaactttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaacttatgacgcaaaaaaaaaaaa

SEQ ID NO: 16094 - DNA, 572 bp, Homo sapiens
aacacacggatgcggaaaccgagacgggctggatggaaaactctttccagacagactccggggccctcaactggtctccgacttcccctgcaacctgcgacacctgccattttcccatcttaggctccagaagcagaatcaagtgggatgtcttggaagaaaaacaaacaaaaggcccactaggtggagtgaaatggatcaggagcaattawgttcaatttcacctttaagttttctcaaaaggaggagcattaagaatcagccaccttagtacatacttaaagatttactgaaacctgatcctgtccccgctgatgaaacatcagaggaatgggatcctgtaggtgaagatcatcagcttataaaatcctgttgccatcaatgggggtagcaggaaaatgatgaagattggttaaggggccagtggactcagcattgaaatgaatcatggacttgaagccaaaagactcagtttgtgtcccagctctctcaagcaaagcccccaaktcccagtttcctcatctataaaaaataataaaaatacttaatggacaaaaaaaaaaaaaaaaaaa

SEQ ID NO: 16095 - DNA, 280 bp, Homo sapiens
caagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacgaaaacctaacttgcgcagaaaacaagatgagattggcatggctttatttgttttttttgttttgttttggtttttwtttttttttttgggctt

SEQ ID NO: 16096 - DNA, 288 bp, Homo sapiens
ccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggctttttggtctccctgggagtgggtggaggcagccagggcttacctgtacactgacttgagaccagttgaataaaagtgcacacctcaaaaaaaaaaaaaaaaaaaaaaaaaaaaaaaaaaaaaaaa

SEQ ID NO: 16097 - DNA, 51 bp, Homo sapiens
accgccgagaccgcgtccgccccgcragcacagagcctcgccttgcagcac

SEQ ID NO: 16098 - DNA, 556 bp, Homo sapiens
aaaaactctttccagacagactccggggccctcaactggtctccgacttcccctgcaacctgcgacacctgccattttcccatcttaggctccagaagcagaatcaagtgggatgtcttggaagaaaaacaaacaaaaggcccactaggtggagtgaaatggatcaggagcaattatgttcaatttcacctttaagttttctcaaaaggaggagcattaagaatcagccaccttagtacatacttaaaggtaaatattacatttaagaaaatccttgttatcttaatgtggcactgagaaaatactatcaagtacagcacgtggactaagttagaacattaaatacacaggatctcttgatagaattatcctcagactttccagttttaatcttctagatttactgaaacctgatcctgtccccgctgatgaaacatcagaggaatgggatcctgtaggtgaagatcatcagcttataaaatcctgttgccatcaatgggggtagcaggaaatgatgaagatttggttwatgggcartgatcagcattgaatgatc

SEQ ID NO: 16099 - DNA, 304 bp, Homo sapiens
  misc_feature 31: n=a, g, c or t
ccacacaggggaggtgatagcattgctttcntgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctcaaaaaaaaaaaaaaaaaaaaaaaaaaaaaaaaaaaaaaaaaaaaaaaaaaaaaaaar

SEQ ID NO: 16100 - DNA, 331 bp, Homo sapiens
ccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctcaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16101 - DNA, 93 bp, Homo sapiens
tcttcagaaggagcagcagccaccgaagaggctgaggatttttggtccgcacgctcctgctcctgactcaccgctgttcgctctcgccgagga

SEQ ID NO: 16102 - DNA, 321 bp, Homo sapiens
atctgattagaaccatatctctcgccgcgcggccactcccggccggcgctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgtctggtgtcaccaagtgtccactggtactgaggtttgctgcctgccttcttgccatgtctaacgaagtagaaacaagtgcaccaatggtcagcccgaccaacaggccgcaccaaaagcaccctcaaaaaa

SEQ ID NO: 16103 - DNA, 470 bp, Homo sapiens
aggacgcctcagccactaggctgcttccggtgtgtcactgaacaccttccccgtaccagcagctggaggatttgtttggtagcacctgggggatggctctgtcccgggcgcacttaggcgggctgtgcggasgcttttaccttccacagtgtccggcacacgcatccttttcgacatcatcacttgacctgctgcaatagacaagtcttgctgtgttgcccaggccggagtgcagtggtgcaatctctgctcagtgcaacctctgcctcctgggttcaagtgatcattctgcctcaggctcctgactaattgggattacaggcatgcaccaccacaccagctaatgtttgtattttcagtggagacggrggttttaccatgttggccaggctggtctcaaactcctgacctcaggtgattcgcctgcctcggcctcccaaagtgctgggtttacaggcgtgasaccgccc

SEQ ID NO: 16104 - DNA, 569 bp, Homo sapiens
attctttcattcaactactgtgcatcaacagcctgccatctaccaccccctcatgaacctccagggcaagctcagtcatctcagaggaagcaaggtgccccaggtaacacagacggctcacagcgaggacccacatgaggtgttattgagcaagacaggaaggcagctttctggataatcgaacgtgctagtgaacagagtgttgccagagatactccaggtgtacactcagatgtatacgtcatatgctccctgagtgattacgtgttccaggctctgagggtaggaaaatgaagacaacagtctctgtctcagggaagctccaggtccacaggggaaaatggaagtcaacgccaagtgtactgcagagtggcaaacaccacagcacaaagtstccagaaacactcatcaggggtcagccatatgctggaaggcaggcaatggcccactccacagggaccctcacaaaacacacaaggcttggatgatgaaggggagatggaaaggctttgtagtttttcagggcaattgtaatgaatggcaattatcatggcaaaaaaaaaaaaaaa

SEQ ID NO: 16105 - DNA, 351 bp, Homo sapiens
acagctggactcagccaacctttatggtttctgtggaatgccatgccaggcgtggggctctgtggagactcaggtgtgrggtctgagagggacacagcaccactatcaaggcaagaggcagctgggaacacgagggtcctgcctctgtctcaaggaccccaggatttcccccagcagctgtcttcctgcctgctttggtttgcgtttttggtttgggtttttttttttttycttttttkggtgtcycwaggstgrggtcatcactgtgtctctcggtctgggtggggcmatctaccctccctgmaastgggagtgtctttgacctcattctataagatacagttcagccta

SEQ ID NO: 16106 - DNA, 517 bp, Homo sapiens
caacagaacggaatttcatggagtggagtgatcacaaatgtcagatatagcagagatctgccacaacaaaaacaccttcaggtattgtcattgggatttcactggtgaccttacaaaagttttttccagtagactggtgagaatggaaaccgaaattcaaattgcactgacgggtggctgagagacaagcatagacagtgagcatagactgttatttgggggaagtataatatacctttgtttattcattcaataaagatttattggccaggtgtggtggcttatgcctgttcggagcactctgggaggctgagatgggtggatcacctgaggtccggagttcaagaccagactggccaatatggtgaaacctgtctctactaaaattacaaaaattagccaggtgtggtggcacatgcctgtaatcccagctgcttgggaggctgaggcatgagawtcgcttgaaactgggaggcagaggttgccaatgagctgagatcgcgccattgcactccag

SEQ ID NO: 16107 - DNA, 466 bp, Homo sapiens
aacccgatgcaaatatttttcttgttggttatttgcctttacttttatttatttgttttgatatgtagatacatttacattttttatgtaatatatctttttaaaaatggtttctgcttttcctgaacatgttttcagaatttaaaattgtatatggaaaacaaattacatgaaagatttgagcatttcaaaattttaaacataaaagcataaacgtagataaaatgaaggtgtactatgatatcttcagttttatcagaaatgatgtaaaaattacaacctctttaaaaagtagtgttaatcattaagttagaaaatatatagctgggcatggtggcagatgctgtaatcccagctacatgggaaggtgaggtgggagaatcgcttgaacccaggcagtggaggatgcagtgagccaagatcatgccactgcaccccagcctgggtgacagacaagactccatct

SEQ ID NO: 16108 - DNA, 272 bp, Homo sapiens
  misc_feature 140: n=a, g, c or t
actctaatctggaaataggtagtcggagaggtggttctgcatggggcctctcacatgtgctacagtcaaacattagccggggccacagtcatctgaaactcacttacatggctgacaattgatgttggctgttgcctggngaagacatatgtggcgtggtggaatggaatggtgactagattcaagaaagagcttcccaggaggaaggctaccaagagaccgaagtagaggcttcagtttcttaaaaaaaaaaataaaaaaaaaaaaaaaaa

SEQ ID NO: 16109 - DNA, 255 bp, Homo sapiens
actctaatctggaaataggtagtcggagaggtggttctgcatggggcstctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaat

SEQ ID NO: 16110 - DNA, 233 bp, Homo sapiens
actctaatctggaaataggtagtcggagaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggct

SEQ ID NO: 16111 - DNA, 271 bp, Homo sapiens
actctaatctggaaataggtagtcggagaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaatwaaaaaaaaaaaaaaa

SEQ ID NO: 16112 - DNA, 440 bp, Homo sapiens
agcgaccaggactgtccaacacgcccccgacctccagacaattgaggagttgtccatctggggacacacagcagtgacaaggacgtagcctttcctaatccctgaagagctcttccgcaggtactctgaagggcaattccagcagaatgtacattccatgacatctgggactttgatgcgttgccccagaagataataccagtacctacagcatgttcacctaagcactggtcaagtggatattactcaaccagaatgcaaacatttctattggttttagtaagacctgaaagaggctgggcgcggtggctaacgcctgtaatcccagcagtttgggaggctgaggcgggcggatcatgaggtcagatgatcaagaccatcctggctaacatgtgaaaccccctctctactaaaaatwcaaaaaaaaaaaaaaaaaagct

SEQ ID NO: 16113 - DNA, 76 bp, Homo sapiens
aagaagaggaaagaggaagaagcgctcagatgctccgcggctgtcgtgaaggttaaaaccgaaaataaaaatgggc

SEQ ID NO: 16114 - DNA, 93 bp, Homo sapiens
aagaagaggaaagaggaagaagcgctcagatgctccgcggctgtcgtgaaggttaaaaccgaaaataaaaatgggctagacaaaaaaaaaaaa

SEQ ID NO: 16115 - DNA, 146 bp, Homo sapiens
aagaagaggaaagaggaagaagcgctcagatgctccgcggctgtcgtgaaggttaaaaccgaaaataaaaatgggctagacargggraaaaaaaaaaaaaaaaaaaaaaaaaaaaaaaaaaaaaaaaaaaaaaaaaaaaaaaaaaa

SEQ ID NO: 16116 - DNA, 485 bp, Homo sapiens
actttgccacagggaggcactgaactgaaaaactgccttgtaagaggtgtcgcccctctgtctactccctttcttatatcaagaggggaaaaacacgtaactacctctacccgatctkktcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatca

SEQ ID NO: 16117 - DNA, 528 bp, Homo sapiens
actttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcgtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttga

SEQ ID NO: 16118 - DNA, 530 bp, Homo sapiens
  misc_feature 526: n=a, g, c or t
actttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcgtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatcccttnaagg

SEQ ID NO: 16119 - DNA, 740 bp, Homo sapiens
agtttttcttgggctgtttgcaaatttgtttcgcagttaaaaggggatttgccagctgggatgggggaattgggaggcagatggggcttccaggagcgaggatagggtcgttggcctcaggtgccgctctccagttaggagtattttaggcacctcgttccttattgtcaggtttaacttcatttgttctcccactttataccttagtgaatttgtagatgtgacaaggctttcgcagttatatagctttcccagatcagtatgttaagaatttaagcagaagttattgagaaaagcaggtgtcttgctttttcacttttcgttcttctttgctcataaaacctttttctgaatctcgggacgacagttatctttcggatggaacgtgatctggatgtctatctaccttattgacttaatcctgttttgtagtggttggttactcgcactatgcagacgtgttgcggtgctgaatacaacatttattactaaagccagacactggatcaccgtcacggcagatgtcagcacacctgttgtaatcaactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaaaaaaaaaaaaa

SEQ ID NO: 16120 - DNA, 327 bp, Homo sapiens
aggtcaggggcgttcccttcatgtcgcggccgcagtagctcctggacgcctccccgaagcagccgtccagcgcccgcccgcagcagagctctgcccggggccgtgacaacgggcgccgccatgttcacaggcacagaatgagacctgagggaggaccccggcgtcggcggcaggaaaggcccccgccagtgctgcctgcgsgcgccgatcacttataaggaagaggaggacttgacactccagccccgttcctgcctccagtgctcctgagtccctagtaggcctccaggagggcaaaagcaccgagcagggtaaccacgaccagck

SEQ ID NO: 16121 - DNA, 395 bp, Homo sapiens
attctttgtactttgaagatctagggattaacagacaagtacagcaacgtgtactagcaaagatgacaggcccaagacacgctaaaactgtaggatttaaaatacgcaaatgtctaacagttggcaaagtatgtgaccaaaaggtgaaggaaatcctgatatcaacttacacttttaaatgctctggaaccaatgagaacaaatacattcatcacaagtaccagctgctcttcttactaaatttaacaataacatgaattttaactcagtgatttccccatcaccaaccccgccaaacacctgtaaatatttaggaaaaacaagctaaaaaaattgaatctaaaaggcaggagaacaaatcattgcaaatcattgtggtgacggactgcacttca

SEQ ID NO: 16122 - DNA, 281 bp, Homo sapiens
gggagttccccggasmaggatcctgcagcccgagtcccgtcctyaggcttccccaatccaggggactcggcgccgggacgctgctatggacgacattttcactcagtgccgggagggcaacgcartyrycrttcgcctgtggctggacaacacggagaacgacctyaaccagggtatcgtcttggatgctttgtgaagagcadgyggaaaggaggcaattgcctarttcatcgtagaagtaatgatgtcttggactagaattaggctcaatgaccattgcc

SEQ ID NO: 16123 - DNA, 272 bp, Homo sapiens
agaggctgcgcacagcggatccggcactcagcgaccggacccaaggatccgccggggaacaagccacaggagagcgactcaggaacaagtgtgggagaggaagcggcggcgcggcgcggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttacccccca

SEQ ID NO: 16124 - DNA, 512 bp, Homo sapiens
attatagccatccccactgccaccaaagccaccatgaccactgaagtttcctccactaccagagttgtcattcccactgaaaccacctccacgaccaccacgtttccagaatcacttagcttctttggctggatgaagcactagccatctcttgctttgacagggctttcctaacttcacaattgttgccattcacagtatgatatttctgaatgacagtcttatccacggagttgtggtcgtcaaaggttacaaaggcaaagcccttttcttgccactgcctcggtcagtcatgatttcaatcacttcagtttttcagaactgtttaaaataatctcttaggtgatgttctttagtgtcttctttaatgccaccaacaaatatctttttcacagttaagtgggcacctggtctttaagaatcttctgttgagacagctctctttggttccacaagtcttctgttcaccttgtgtggccttgcattcatggctgcatcctccacctccacag

SEQ ID NO: 16125 - DNA, 313 bp, Homo sapiens
gcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaac

SEQ ID NO: 16126 - DNA, 418 bp, Homo sapiens
  misc_feature 94..95,159: n=a, g, c or t
agccttgtagtggggctggagcagagcctgccgcgaacccccggagcccacgatccctcgtgccatccctcgaatccaccagcacgagcgtscnnccgcgcctgggaccatggccactgactcatgggccctggcggtggacgagcaggaagctgcggnctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaaagagcttcggctgaaaccacagc

SEQ ID NO: 16127 - DNA, 293 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaa

SEQ ID NO: 16128 - DNA, 326 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaarrraaaaaaaaaaaaaaaaaaaaaaaaaaaaar

SEQ ID NO: 16129 - DNA, 319 bp, Homo sapiens
  misc_feature 261: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaatbmnrctcctttaaatttaaaaaaaaaaaaaaaaaaaaaaaaaaaaaaaaaaaaaaaaaaaa

SEQ ID NO: 16130 - DNA, 301 bp, Homo sapiens
  misc_feature 192..195: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccnnnnagtctctctgaatctgccgtgatcctgggggctgcccgattcgtgcattgttcattgctcaattaaactcctttaaatttaaaaaaaaaaaaaaaaaaaaaaaaam

SEQ ID NO: 16131 - DNA, 323 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaaaaaaaaaaaaaaaaw

SEQ ID NO: 16132 - DNA, 306 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaar

SEQ ID NO: 16133 - DNA, 310 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaara

SEQ ID NO: 16134 - DNA, 310 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaaaw

SEQ ID NO: 16135 - DNA, 341 bp, Homo sapiens
  misc_feature 201: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtmwntctgaatctgccgtgatcctgggggctgcccgattcgtgcattgttcattgctcaattaaactcctttaaatttaaaaaaaaaaaaaaaaaaaaaaaaaaaaaaaaaaaaaaaaaaaaaaaaaaaaaaaaaaaaaaaaar

SEQ ID NO: 16136 - DNA, 347 bp, Homo sapiens
  misc_feature 237..238,253..254,347: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgathnntgcattgttcattvnncaattaaactcctttaaatttaaaaaaaaaaaaaaaaaaaaaaaaaaaaaaaaaaaaaaaaaaaaaaaaaaaawwwaaaaaaaaaaaaaaaan

SEQ ID NO: 16137 - DNA, 348 bp, Homo sapiens
  misc_feature 265: n=a, g, c or t
attaccktcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattamrchnkmttaaatttaaaaaaaaaaaakkaaaaaaaaaaaaaaaaaaaaaaaaaaaaaaaaaaaaaaawaaaaaaaaaaaaaaaaaaw

SEQ ID NO: 16138 - DNA, 351 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaamamwaaawrwrmaavvarrwamttckcvcadhvhdrgwwaammmwrrawwtammaatamwwwaaaaaaargct

SEQ ID NO: 16139 - DNA, 300 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaar

SEQ ID NO: 16140 - DNA, 351 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgktcattgctcaattaaactcctttaaatttaaaaaaaaaaaaaaaaaaaaaaaaaaaaaaaaaaaaaaaaaaaaaaaaaaaaawtwaaaaaaaaaaaaaaaaagct

SEQ ID NO: 16141 - DNA, 327 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaaaaaaaaaaaaaaaaaaaaaaw

SEQ ID NO: 16142 - DNA, 322 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagcccaaaaggccgagaagcgatcatccctggagtctctctgaatctgccgtgatcctgggggctgcccgattcgtgcattgttcattgctcaattaaactcctttaaatttaaaaaaaaaaaaaaaaaaaaaaaaaaaaaaraaaaaaaaaaaaaar

SEQ ID NO: 16143 - DNA, 328 bp, Homo sapiens
  misc_feature 278,280..284: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaanbnnnnnaaaaaaaaaaaaaaaaaaaaaaaaaaaaaaaaaaaaaaaaaaaw

SEQ ID NO: 16144 - DNA, 328 bp, Homo sapiens
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctggaatctgccgtgatcctgggggctgcccgattcgtgcattgttcattgctcaattaaactcctttaaatttaaaaaaaaaaaaaraaraaaaaaaaaaaaaaaaaaaaaaaaaaaaaaaaaaw

SEQ ID NO: 16145 - DNA, 354 bp, Homo sapiens
  misc_feature 324..325: n=a, g, c or t
attaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaaaaaaaaaaaaaaaaaamrraaamaaaaaaaasaaaaaawmammaaannrravaawtamaaaaaaaaaaaaaaaagct

SEQ ID NO: 16146 - DNA, 479 bp, Homo sapiens
ttggggaatgggaatgtacctgtaagcaggaatatggaattgttgattgtagccactgtgatgaattaatctattacagcttttcaatttatgtggctattcattcaaggagtagatatgggagactttttctatgccctgagagactccagggagtgtgtattggccctccttctggctacccgttctgtagttcctcttttttggaatctgcatatgtaccaaggcctggagacaggaaaatgaatgctgagggactgactcagtggttctaccatttcccactctcgaatgtgtcagtatgtagcacttcataggcaagcaggttaacctgcatccacttttcagccagttggctttccgagaataggtgcttagggttacttgaatgagaaggtagaaggagggacagagggctggataagccttgctgctgcctaataaatagccatgggagggcccaggctcatattactcat

SEQ ID NO: 16147 - DNA, 410 bp, Homo sapiens
  misc_feature 338: n=a, g, c or t
rgtrccctttcctcctcccaccgcgcaccaaaacatggggtccawgatcttctgtwgttgccgcaagaccagcgaggggtcttccaccactgttggcttccrsaatccaagrrtgttcgaacagcatcatccacggtccttcaatctgaacacaaattctctccacagtgctgtaccaaaaagacatccacgcctcccctatgacaaccgcatgatgctcaaggcgtgcrtccttaggaggccatgagcattctagccggcggacccacgtggtccctgcggctgcacagctgstgggcttccatgaggaagagggcagtggacaggagtcatgawrnctgattcagaarctcccctgcarraggagaagacgtctgagccatccctgtgccaccaccaagagtcactcc

SEQ ID NO: 16148 - DNA, 396 bp, Homo sapiens
gagctgagccctgtgcggccgccgccacaatgggccgcgagtttgggaatctgacgcggatgsgcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcaaaaaaaaaaaaaaa

SEQ ID NO: 16149 - DNA, 393 bp, Homo sapiens
ctcgttggtggggctgggggatgagagctgcaccgcgcgggacaagtcgccggckgccccgacggagcaggtaaaatgtggataatacggccgggcgcggtggttcatgcctgtaatcccagcactttgggagaccgaggcgggtggattgcctgaggtcaggagttcgagaccagtctggccaacatggtgaaaccccgtctctactaaaaaatacaaaataaatttgccaggcatggtggcatgcgactgtaatcccagctactcaggaggctgaggcaggggaattgcttgaaccagggaggtggaggttgcagtgagctgagatcgcaccactgcactccagcctggatggcagagcgagactccgtctcaaaaatacataaataaata

SEQ ID NO: 16150 - DNA, 434 bp, Homo sapiens
tttacctcttctgggccccctgtggacctgcgttgacccagcatggctacaatgggggagttgggtaatcgctcccgttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacttcttaggatgaacccagccagctgcgttcctggcctctgcagaatggcatacagaaggcattttaagcaagcgagctgagctsgacgcagac

SEQ ID NO: 16151 - DNA, 353 bp, Homo sapiens
accccataccccctccccatcttgtgatcaccctcattacctcttctgggccccctgtggacctgcgttgacccagcatggctacaatgggggagttgggtaatcgctcccggtaggttcctccccaacccccgaggcggggtcaggtggagcgtgggcgccagagcagcccctctgccttgggtgtcttggagatgacttggcgccccccggagccccgtcatggctgtggctgcgtccacaacactgcatcagcagagtcctggggaagccatttaggaatctgaagcccgggatttctgctttgtcccttcaggggttcctgagcctgttaaaaaaaaaaaaaaaaaagc

SEQ ID NO: 16152 - DNA, 110 bp, Homo sapiens
attacctcttctgggccccctgtggasctgcgttgacccadcatkgctacaatgggggagttgggtyatcgctcccggtaggttcctcsccaasccccgaggcggggtca

SEQ ID NO: 16153 - DNA, 559 bp, Homo sapiens
aaactgcctgggaatgtagcccactgggtgtcykscycattttactcagcccctattcaagatggagttactctggttcacacacctctgacatgacctccaacaagttgtgaacattgagagaaaacccaaactgcccaagatgaggaagttagtgagaaagtggtacctaaagccatgataccaacgagctctatgcttcttgaaaggtggtaactttgtgagacaagcctcaaattttaccactgtaccaagaaatgaaagccagaatgtggaattggagctggtaatgacgacgtcaggacaggttcaaaggaagcccatcacttgagtaaaaatttatagccctgcttgtgctgtgctgtgctgtgctgtgagtttcagttccgggccagcaaaagatttatcaaaggaaagcaacaaggtgtgtggaaatagaaggggctcttcaatgaccaaaggccataagagactggaaggcaaaaggacccattaatgtaatccaaacatcagtctcctgcagcaaagaggtgawkgagaagggtggagatactgtgga

SEQ ID NO: 16154 - DNA, 193 bp, Homo sapiens
aaactgcctgggaatgtagcccactgggtgtctgcctcattttactcagcccctattcaagatggagttactctggttcacacacctctgacatgacctccaacaagttgtgaacattgagagaaaacccaaactgcccaagatgaggaagttagtgagaaagtgggtaccctaaaaagcccattgataccca

SEQ ID NO: 16155 - DNA, 498 bp, Homo sapiens
aaactgcctgggaatgtagcccactgggtgtctgcctcattttactcagcccctattcaagatggagttactctggttcacacacctctgacatgacctccaacaagttgtgaacattgagagaaaacccaaactgcccaagatgaggaagttagtgagaaagtggtacctaaagccatgataccaacgagctctatgcttcttgaaaggtggtaactttgtgagacaagcctcaaattttaccactgtaccaagaaatgaaagccagaatgtggaattggagctggtaatgacgacgtcaggacaggttcaaaggaagcccatcacttgagtaaaaatttatagccctgcttgtgctgtgctgtgctgtgctgtgagtttcagttccgggccagcaaaagatttatcaaaggaaagcaacaaggtgtgtggaaatagaaggggctcttcaatgaccaaaggccataagagactggaaggcaaaaggaccccattaat

SEQ ID NO: 16156 - DNA, 390 bp, Homo sapiens
aacaaggtcgtgaaaaaaaaggtcttggtgaggtgccgccatttcatctgtcctcattctctgcgcctttcgcagagcttccagcagcggtagggggggccaagagcatccggagttcacaacctctgtggtccgtagagccactatgaggagggccctgggaagaatttgccattttsagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatctttgtcaat

SEQ ID NO: 16157 - DNA, 512 bp, Homo sapiens
  misc_feature 298: n=a, g, c or t
agcctgaggcatctaagaaaagctgtaagggtctcatcaagcagcatatacctcagctgcaagtcacagctgaccacaaagattctgccttctctagtgaggtcagcctgccttaaaggaccagccctctaaggggtatattggcttgcctgatggaagagaaagtcagatgcaggctcaattttcctttaggcctctccttgctttcctcctgtgcccaaagtcaatgattttctaagagtcctctttactgattgccttgggctccactagttatgggatgaaaacttgaattgancagcagccaggacattggggtgacacagcatcttctacaaataaatctgtcagaggtatttgctggtgattgctgcacagtaagccaggctagaactcgatgacgtaaatgaataagcatttattactgcttactagtctattggtctgctgcatagttctggtctctgaaagaatcaggcatctacggtcagctgtgagccaactgtgagcaa

SEQ ID NO: 16158 - DNA, 476 bp, Homo sapiens
ctcctgaccttaggctatccaaccgccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaggctgaggcgggcggatcgctgaggtcgggagtttgagaccatcctggccagcgtggtgaaacccatctctactaaaaatgcaaaaattggccgggcatggtgacacatgcctgtagtcccagctacttggaaggctgaggcaggagaatcgc

SEQ ID NO: 16159 - DNA, 523 bp, Homo sapiens
tgtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctg

SEQ ID NO: 16160 - DNA, 157 bp, Homo sapiens
cttaaagaagcatgctactaattgctttttttctaaattaaaactatgtactgtggtaaattaaaaatctgcaggaaaaattgcttagtgttttagcacaataagaatttttattactcaggagtttggagacccagtctgggcagtacggtgaaac

SEQ ID NO: 16161 - DNA, 201 bp, Homo sapiens
cttaaagaagcatgctactaattgctttttttctaaattaaaactatgtactgtggtaaattaaaaatctgcaggaaaaattgcttagtgttttagcacaataagaatttttattactcaggagttggagaccagtctgggcagtacggtgaaacctgtcgctactaaaatacaaaaaaaaaaaaaaaaaaaaaaaaaaaa

SEQ ID NO: 16162 - DNA, 202 bp, Homo sapiens
cttaaagaagcatgctactaattgctttttttctaaattaaaactatgtactgtggtaaattaaaaatctgcaggaaaaattgcttagtgttttagcacaataagaatttttattactcaggagttggagaccagtctgggcagtacggtgaaaccctgtcgctactaaaatacaaaaaaaaaaaaaaaaaaaaaaaaaaaa

SEQ ID NO: 16163 - DNA, 201 bp, Homo sapiens; identical to SEQ ID NO: 16161

SEQ ID NO: 16164 - DNA, 201 bp, Homo sapiens
cttaaagaagcatgctactaattgctttttttctaaattaaaactatgtactgtggtaaattaaaaatctgcaggaaaaattgcttagtgttttagcacaataagaatttttattactcaggagktggagaccagtctgggcagtacggtgaaacctgtcgctactaaaatacaaaaaaaaaaaaaaaaaaaaaaaaaaaa

SEQ ID NO: 16165 - DNA, 201 bp, Homo sapiens; identical to SEQ ID NO: 16161

SEQ ID NO: 16166 - DNA, 200 bp, Homo sapiens
cttaaagaagcatgctactaattgctttttttctaaattaaaactatgtactgtggtaaattaaaaatctgcaggaaaaattgcttagtgttttagcacaataagaatttttattactcaggagttggagaccagtctgggcagtacggtgaaacctgtcgctactaaaatacaaaaaaaaaaaaaaaaaaaaaaaaaaa

SEQ ID NO: 16167 - DNA, 202 bp, Homo sapiens; identical to SEQ ID NO: 16162

SEQ ID NO: 16168 - DNA, 527 bp, Homo sapiens
tatgtgccaccttccatcccctttcccagcagatggtaattgatgcaatttgagaatagaacacttcattgaaacaagtcactggaggtcctctggggatgcagcttaaaagcccaggatcaggccaggtgtggtggctcacgcctgtaatcccagcactgtgggagactgagacgggcagatcacctgaagtcaggagttcgagaccagcctggccaatatagagaaaccccgtctgtactaaaaatacaaaaattaggtctgggcggtggctcacgcccgtaatcctagcactttgggaggccgagaaaggtggatcacgaggtcaggagttcgagaccagcctggccaacatggtgaaacccgtctctactaaaaatacaaaaattgggtgtggtggtacatgcctgtaatcccagctgcttaggaggctgaggcaggagaatcacttgaacccaaaaggcagaggttgcagtgagccgagatcacgccactgcactccagcctggcaacagagcgagactctg

SEQ ID NO: 16169 - DNA, 489 bp, Homo sapiens
ttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagc

SEQ ID NO: 16170 - DNA, 409 bp, Homo sapiens
  misc_feature 386: n=a, g, c or t
aattttcggtactggtgccatcacaactgctgatcgtttctgcaggattccagaaaataatgtatccatgatacagagtgtatacaagttttgcgattacgccttctgcgtaacagtcagtcccaccgcagtttaacccacaaggaattttctcttgtcctaaactattatggccttctttgtccgattgaacggaggtaacgaagtctcgtcttccgccagtcgtccgggcgaasagtctggagccgctccggagcgcgcgttgtgattggctcttayattacttttctacctaattcgtatccttggggtgacagattttccccactacaaggaagactgggaagttctaagcaccgtcctttggcaggaaaaaacaaacaaancaaracaaaaaaacagaaggccg

SEQ ID NO: 16171 - DNA, 492 bp, Homo sapiens
attttgattggtgttggatttatttgtaggagaggctcctgagcgctaggtccgcactgtggtgactgaacccagaagtcggggagcagttgtsctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacstgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggcagcttcttcttggcacaatcctgaactgggcagaacgtccttcccaaactcggcggaagacaaatggctcctgtgacaccctgaggcttacgtt

SEQ ID NO: 16172 - DNA, 489 bp, Homo sapiens
agtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggcacagtgacttttgaagacgtggctgtgaaatttacccaggaggaatggaatctccttagtgaggctcagagatgcctgtaccgtgatgtgacgctggagaacctggcacttatgtcctccctggggaaagaaacagtagctccactcctgccggtccctcccctaggggagagggaagcagaggagaaaacagcagcataggtggctggcaaagacaaaggaaagaccagtagaagagaaagaaaccaaaaacagcaagcgcgagccaaacagccaggcaggta

SEQ ID NO: 16173 - DNA, 479 bp, Homo sapiens
atcatctaggttttcagccctgcatgcattaggctggagtgcagtggtgtgatctcggctgactgcaacctccgcctcccgggttcaagcgattctcctgcttcagcctcccgtgtagctgggattacaggcatgcaccaccacctccagcaaatttttgcatttttagtggagacactgattcaccatgtatcccatgctttttgatcagactaaaccatctactccttatcttgggatctgcctatggggagaagtgggtcgtagmagactctaaggtgtttgtggccaccaggatgaagacaagaacagagaatgagaggtagtctgaattgtcctgccaggcagtaataccaccttcttgtgaaaaggagattctatctatgtcctcaatgctgatgaatcatcttttccctcttccttttatgactgttatgagtgttgagagtttaaagctattcattccagcatgctgccac

SEQ ID NO: 16174 - DNA, 333 bp, Homo sapiens
  misc_feature 15,78,239: n=a, g, c or t
aagatttttcaagcnagatgaagtccatcatcctctttgtcctttccctgctccttatcttggagaagcaagcagctntgatgggacaaaaaggtggatcaaaaggccaattgccaagcggatcttcccaatttccacatggacaaaagggccagcactattttggacaaaaagaccaacaacatactaaatccaaagdcagtttttctattcaacacacatatcatgtagacatcaanyratcatgactggacccgaaaaagtcagcaatatgatttgaatgccctacataaggcgacaaaatcaaaacaacacctaggtggaagtcaacaa

SEQ ID NO: 16175 - DNA, 400 bp, Homo sapiens
  misc_feature 237..240,326..327: n=a, g, c or t
aagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcnnnnmrdcatgactggacccgaaaaagtcagcaatatgrtttgaatgccctacataaggsgacaaaatcaaaacarcacctaggtgggannadacaactgctcaaaattataaacaagaaggcagagaccatgataaatcaaaaggtcattttcacatgatagt

SEQ ID NO: 16176 - DNA, 504 bp, Homo sapiens
aagcctttggattacagctctgatgtttctggtagccatctttttctaatatctctgtgaaggtcaacccctgactcctaaggtaaccttttaaggtggagaccggtggcctgtttggggcagttcccctctagagggagaatttgtctctgaagtaccaggagactgcaggagattttcctgtgcttttcctacccagacaccagcccagaactcaggtgacttcaggagcgttcacatcctgtttggaaacaaagtctgcaaattgtttaataggccgagccttgatatccgcatccctctcagctctatcacaggtctgctttgctgttttctcttggctgtgacagtccgcctgatggtcattataacagcagttcaccattagtacaaacaagagtaccatacataaattctgtgcgcggtttaccaacatcatcaaaaagttatattgttctactgttctcattctttacttgatcacatcattaatcatatcaacat

SEQ ID NO: 16177 - DNA, 418 bp, Homo sapiens
  misc_feature 306: n=a, g, c or t
agatttttcaagcaagatgaagtccatcatcctctttgtcctttccctgctccttatcttggagaagcaagcagctgtgatgggacaaaaaggtggatcaaaaggccaattgccaagcggatcttcccaatttccacatggraaaaaagggccagcactattttggacaaaaagaccaacaacatactaaatccaaaggcagtttttctattcaacacacatatcatgtagacatcaatgatcatgactggacccgaaaaagtcagcagtatgatttgaatgccctacataaggcgacaaaatcanaaacaacacctaggtggragtcaacaactgctcaattataacaagaaggcagagacccatgataaatcaaaaggtcattttcacatgatagttatacatcataaaggaggcc

SEQ ID NO: 16178 - DNA, 531 bp, Homo sapiens
cttttttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcrtgcggtatgaggaagagggcatgtcctacctctacgcctcctggatgtatcagcttcaacatggagatcagctaagcatttgcttcacctgcttcaaggctgcctttctagactttaaagacttgctggagtcagargactgggragaagacaactgggacctgagctgatggagcacactgaggcagagtcagagcag

SEQ ID NO: 16179 - DNA, 403 bp, Homo sapiens
aatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccwrmmcmacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggasccccgaatgcagggaagtcaacactctccaaccagctactgg

SEQ ID NO: 16180 - DNA, 494 bp, Homo sapiens
ttttaacttctctctataaggaactgatttcatctgaaattgaagagacaatcagagaaaaactatagaccactcatgatggttgttatatgtgcttggstgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcatgtaagccaattccttaaaataaattctctgtcctgtttttgccccctctctctttctgacagcacacacatgccctctt

SEQ ID NO: 16181 - DNA, 396 bp, Homo sapiens
  misc_feature 390: n=a, g, c or t
actatgctcaagtccaggcaacgtacaggcaggggaaatgtctcttccaaggctaaaagtaaacatcagaacatatgataattccattccaatcaktgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccanagatga

SEQ ID NO: 16182 - DNA, 547 bp, Homo sapiens
aggtatctaggtatcctcccatctcaggccagactggagattgagcgcctgttgtatacgggccctgggctaaccctccccccatcacacaactcaacagcaacgcccaagccacaacttctctggacctcaggttccctacctgcaaaacagtttgcacctcctccctccacaaaactgcaaccggggccggcgcggtggctcacgcctgtcatcttaacaccttgggaggcggaggtgggcggatcatcagaggtcaggagttcgagaccagcctggccaacaaggtgaaaccccatctgtactaaaaatacagaaatcagccgggcatggtggctcgcgcctgtagtcccagctacttgggaggctgaggtaggagaatcgcttgaatccgggaggtggaagtcgcagtgagccgagatcgcgccactgcactccagcctgggtgacacagtgagactccacctcaaaaacaaaacaaaacaaaaaactgcccgcagagagctgcccccgaccacaaggcctgaatccagccttccagccccag

SEQ ID NO: 16183 - DNA, 481 bp, Homo sapiens
caacagttcagcaagaaacatgttattcgatccattcactgaggaggaaactgaaatcactcggagaggaggagtgattcagccccaaattccaaagtgacaggggtatatgtcagagccattcttccagatcagatgacctgttaaactgagacttctgcaccatctgaaccatcagtcactcatctgaaccatcagtcactctctggcccagagaggtggtgttatttgccaaggacacacagcaggtggccaagatggagccaagccattttccccactgcagggacccctgatctccattcccctggacatctcaagggcacaaattctctggacacacggagggaataatgctgacattttatagaagctgacccactggatatccttctcacccaactccattaggctggggagagtaagaggcacggtgacaaggtggcaaagatgtcaccatgccatccaatcacgaggtctc

SEQ ID NO: 16184 - DNA, 409 bp, Homo sapiens
gagaattttctgcaagamataaaaaatgcaaaatcagaagcaagtatttataagaatagcttgtcagaaattggcaaggaatgtgaaatgttatcaaaaatggtaatggaaaccaaaacagataatcagattctaaaagaagaactaaagaaacatagtcaagaaaatataaaatttgaaaacagcatcagtagacttactgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttatatttcaagaagagagaaattccattttgacaactatactcacgaagatacttctagtc

SEQ ID NO: 16185 - DNA, 413 bp, Homo sapiens
ctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtgggatgagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaatttccattttgtgaatgggtttttttttttaataaactgtattaacaaaaaaaaaaaaaaaaag

SEQ ID NO: 16186 - DNA, 431 bp, Homo sapiens
tacaaatactcatcttgatgtgtttaaacatgttgagacagttctgtctgaggtgaggaacaaattaaggatagatacattggtttcttattaatttagtgtttaagacagtgcttatttccttggggaaaaatactgtaaagaaaaagaaaacacctggtacggtgagtcacgcctgttaatcccagcactttgggaggccaaggcgagtggatcatgaggtcaggagatggagaccatcctggctaacacggtgaaacccttctctactaaaaatacaaaaaattagccgggcgtggtggtgggcactgtagtcccagctgctcgggaggctgaggcaggagaatggtgtgaacctgggaggtggagcttgcagtgagtggagatggtgccactgcactccagcctgggtgacagagtgagactctgtc

SEQ ID NO: 16187 - DNA, 199 bp, Homo sapiens
agagtcgcacgcgcrgggaaggtgtgagtcgtgaacggcccgggtctccgccatggcctctctactcgccaaggacgcctacctgcagagcctggccaagaagatctgctcccattcggccccggaacagcaggcgcgcacsggctggcaaaactcaaggctcagaaactgcagggcccccaaaaaaaaaaaaaaaaag

SEQ ID NO: 16188 - DNA, 464 bp, Homo sapiens
tagaaggtggagatgctggcaacagggaggaccarattccaaaccaggcttattagaagaatgaactaaggtgagagacctcatcctgagaaaggttgagttaatgttagagtataagtggtggtaatcttgaatacttttcccattaaatattgatgggggtttgaattttaatcagtgcttttgtggggagtgggggtcaactatcttaatgattacagttggtttgtttactgcttttgaggacctttctggaggaaaggaaaagcctgttttggggagtctttaaagatggaaattgggtggtcttaaaaatgtaaactcaatcattactttataactgcctagtttatgttaattgttagctgcctaaagtgttttctaatggttttctttttttcctttcaggtgtctaccatgattatttttctaagctggttggttaataaacagtacctgctctc

SEQ ID NO: 16189 - DNA, 265 bp, Homo sapiens
aacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaagctggcaac

SEQ ID NO: 16190 - DNA, 458 bp, Homo sapiens
atttaaatagttccaagtaggggagaccagctgcccctgaaccccagaacaaccagctggatcaattctcataggagccacagcgcggagactgtgaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtatgcgcagacaccagcaaacatgttctatatagttgcatgtgacaacagggatcaacgacgggaccctccacagtatccagtggttccagttcacctgcataccatcatctaagctcctgtatcagcactcctcatcatcactcatctgccaagctcctcaatcatagccaagatcccatccctccatgtactctg

SEQ ID NO: 16191 - DNA, 477 bp, Homo sapiens
aagaagacctcccgctaccctggagagctgggtttaagacatttgccagcacaccactgcccagggaccagtctcagctccagagctgtgggttattggtaaaggatgtgatttcattgagcctcagtttctgtatctgtaaagcaggaatctatcacttatgaaatatcctgtgcaggcacaatcttaggtgtggaggatacaatacaactctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaagtcctcctgtctgactacttcagaattgggacatatcgataccgtcgacctcgagggggggcccggtacccaattcgccctatagtgagtc

SEQ ID NO: 16192 - DNA, 488 bp, Homo sapiens
atttacaccatcgacatcagcaaatgcaaccaagacctcccgctaccctggagagctgggtttaagacatttgccagcacaccactgcccagggaccagtctcagctccagagctgtgggttattggtaaaggatgtgatttcattgagcctcagtttctgtatctgtaaagcaggaatctatcacttatgaaatatcctgtgcaggcacaatcttaggtgtggaggatacaatacaactctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaagtcctcctgtctgactacttcagaattgggacattggctttttcctgcctctacactacaactacaccatcaag

SEQ ID NO: 16193 - DNA, 211 bp, Homo sapiens
aagaagacctcccgctaccctrggagagctgggtttaagasatttgccagcacaccactgcccagggaccagtctcagctccagagctgtgggttattggtaaggatgtgatttcattgagcctcagtttctgtatctgtaaagcaggaatctatcacttatgaaaatatcctgtgcagggcacaaatcttaggtgtgggagggatacaat

SEQ ID NO: 16194 - DNA, 461 bp, Homo sapiens
attttttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgcaaaaaaaaaaaaaaaa

SEQ ID NO: 16195 - DNA, 447 bp, Homo sapiens
acaagcaccctgagaggaagttaaggatattatccttttcagcactggtctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaagtcctcctgtctgactacttcagaattgggacattggctttttcctgcctctacactacaactacaccatcaagccttcagacatggaaaggaaccacactattggctctcctcggtcttcagcttgccaactcaatgcagatctttgcatttgtcagccttataaccatgtgagctaattccctaaaataaatgtcctcatttaaatgtaaaaaaaaaaaaaa

SEQ ID NO: 16196 - DNA, 493 bp, Homo sapiens
tcaggctttttgactacttcggctctaggctctgttcatactgcatttacaagcaagagcaaggaggccagggcaaaatagcttttattttattagaaagttcagtacctttccacaaacttcccattgcatcttactcaccaaaattgggtcaattccacactagttgcaagggagggtgaggacatgaacatccagcaaaggggaaacaaatagttttaattggattagacccataatgacttatcattgagacttcacatactgctgaaacaaaactgttcagcttataaggaagaagaaagggatgacaaattgattgctaacatattctgccatagaaggcagttatttaattttccaaactcattgacatttagattatgtatactctgtgctattaaaaataatacttcaggccaggcgctgtggctcacgcctgtggtcccagcactttgggaggctgaggcaggcggatcatgaggtcaggaga

SEQ ID NO: 16197 - DNA, 369 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgac

SEQ ID NO: 16198 - DNA, 441 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttggatttgtagcttgtgacagaccccaagccagaagagtcaggtaagcagtgcctgcactcctgacccatggcaactggcatgataaatg

SEQ ID NO: 16199 - DNA, 478 bp, Homo sapiens
attttgctctggacgcactgatgttcccggctcgccgccgtgccgcagtcacgaggctctccgaacgcctttcactgtgtttctgtttacattcgcgtctgcaagaccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttt

SEQ ID NO: 16200 - DNA, 435 bp, Homo sapiens
attttgctctggacgsactgatgttcccggctcgccgccgtgccgcagtcacgaggctctccgaacgcctttcactgtgtttctgtttacattcgcgtctgcaagaccggcggcgcgaccgaggcccgaacagatggagatgggctgccatgttgtgagctgcsccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttcsssagtgaagccttcatgtgagactgcagcccacttgacactttgatttgtagcttgtgacagaccccaagccagaagagtcaggtaagcagtgcctgcactcctgacccatggcaactggsatgat

SEQ ID NO: 16201 - DNA, 451 bp, Homo sapiens
attttgctctggacgcactgatgttcccggctcgccgccgtgccgcagtcacgaggctctccgaacgcctttcactgtgtttctgtttacattcgcgtctgcaagaccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacaggaccccaagccagaagagtcaggtaagcagtgcctgsactcctgacccatggcaactggcatgataaatgttttttccca

SEQ ID NO: 16202 - DNA, 492 bp, Homo sapiens
attttgctctggacgcactgatgttcccggctcgcgccgtgccgcagtcacgaggctctccgaacgcctttcactgtgtttctgtttacattcgcgtctgcaagacccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagata

SEQ ID NO: 16203 - DNA, 364 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagctt

SEQ ID NO: 16204 - DNA, 146 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggct

SEQ ID NO: 16205 - DNA, 467 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggsaactggcatgataaatgttttttccatgaagctatgttttagag

SEQ ID NO: 16206 - DNA, 463 bp, Homo sapiens
attttgctctggacgcactgatgttcccggctcgccgccgtgccgcagtcacgaggctctccgaacgcctttcactgtgtttctgtttacattcgcgtctgcaagmccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttt

SEQ ID NO: 16207 - DNA, 430 bp, Homo sapiens
aacagcggggcgtcacctcggacatacgaacagcgggcggtgttcccggctccgtggggccgtcttcccggcgagtccgcgacgrtcgccgcccacggsaggtacgaggttttaaaaagtttttaatttggaaggcagggtgcrgtggctcacgcctttaatcccagtactttgggaggccgaggcgggcggatcacgaggtcaggagatcgagactatcctggccaacatggtgraaccccgtctcaactaaaaatacaararattrgcggggcgtgatggcgggtgcctgtcgtcccakctrctcgggaggccgaggcrggagaatcgcttgaacctgggaggcggaggttgcagtgagccgagatcgcgccactgcacttctgcctggcaacagagcgagactgcgtctcaaaaaaaaaaaaaaaaa

SEQ ID NO: 16208 - DNA, 444 bp, Homo sapiens
acttccgccagcccgccacagcgggcgtcacctcggacatacgaacagcgggcggtgttcccggctccgtggggccgtcttcccggcgagtccgcgacggtcgccgcccacggcagggtacgaggttttaaaaagtttttaatttggaaggcagggtgcagtggctcacgcctttaatcccagtactttgggaggccgaggcgggcggatcacgaggtcgggagatcgagactatcctggccaacatggtgaaacccgtctcagctaaaaatgcaaaaaattagcggggcgtgatggcgggtgcctgtcgtcccagctactcgggaggccgaggcaggagagtcgcttgaacctgggaggcggaggttgcagtgagccgagatcgcgccactgcacttctgcctggcaacagagcgagactgcgtctcaaaaaaaaaaaaaaaa

SEQ ID NO: 16209 - DNA, 453 bp, Homo sapiens
cttgtcggcgccattttgtctcggcakcggtggccgtagctccatcgcattttatgtttctggcgagaagggaacggagttttcatcaggtagattggtttttgtgcggccgtcctccaccgtttcctccaggacagcacctagtcgtgkccggagagtctcagagctgtcagaaaggtgagcatttgtacagtgaaacattttgctacacaaaagtgatrtttaggaatactaacaaattattttcaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataaggtactcagtctttgcttaaaataaattttacgtttatcaaagcaaaaaaaaaaaaaaaa

SEQ ID NO: 16210 - DNA, 204 bp, Homo sapiens
tgttaaattagctaaatcatgtaaccgcagataggaagggctcgcctggggaaactctggtttccgatgggacaggaaagtcatacgggcaacagtatgcggaaagtacgttttttaagtaaaaaaacaaaggcaaactttgtactatccagttatctaaggaacaataaaaacattaggagatcagaaaaaaaaaaaaaaaaa

SEQ ID NO: 16211 - DNA, 393 bp, Homo sapiens
cattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaagcaaaaa

SEQ ID NO: 16212 - DNA, 343 bp, Homo sapiens
attttgtctcggcagcggtggccgtagctccatcgcattttatgtttctggcgagaagggaacggagttttcatcaggtagattggtttttgtgcggccgtcctccaccgtttcctccaggacagcacctagtcgtggccggagagtctcagagctgtcagaaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaactttttt

SEQ ID NO: 16213 - DNA, 440 bp, Homo sapiens
atttttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatggcaaaattaagcagatgctccagtttgagaaacctggatctgcgatctgtttgtgaggtgaagaagaaagaaaatgaaacatactcaagatttaagaaagagggaacgagcagtaccattcactgatttggcaagtcaagaaaagccactgagtggtattcagttaagagaacaattatttcgtataagccacatcagagacgactgaagatgaaaaaactaccatccccgtatataactaatttgtgctgtgca

SEQ ID NO: 16214 - DNA, 507 bp, Homo sapiens
ggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggcacagcactttgggaggctgaggcgggcgtgagattgggagtttgagaccagcctgaccaacatggagaaaccgcatctctactaaaaatacaaaattagcctggcgtggtggcgcatgctgtaatcccagctactctggaggctgaggcaggagaaccgcttgaatccgggaggcgaaggtcacggtaccagcatcaagatgatttatggtaataaggctgggtgcagtggcttgtgcctgtaatcccagcactttggga

SEQ ID NO: 16215 - DNA, 478 bp, Homo sapiens
tttgtctcggcagcggtggccgtagctccatcgcattttatgtttctggcgagaagggaacggattttcatcaggtagattggtttttgtgcggccgtcctccaccgtttcmtccaggacagcacctagtcgtggccggagagtctcagagctgtcagaaagtgcaagaaatcagccagcgtggtggcgtgcacctgtgttccccgctaatcaagaggctgaggtgggatgatcacctgagtccaggagatcaaggctccagtgaaccatgattgtgccactgaactccagcctgggtgacagacttcatctcaaatatatagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctcta

SEQ ID NO: 16216 - DNA, 363 bp, Homo sapiens
atttttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaragaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaactttttttttttttttttttttttd

SEQ ID NO: 16217 - DNA, 322 bp, Homo sapiens
tttatgtttctggcgagaagggaacggagttttcatcaggtagattggtttttgtgcggccgtcctccaccgtttcctccaggacagcacctagtcgtggccggagagtctcagagctgtcagaaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaacttttttttttttttttttttttt

SEQ ID NO: 16218 - DNA, 359 bp, Homo sapiens
aaaccagcttgtcggcgccattttgtctcggcagcggtggccgtagctccatcgcattttatgtttctggcgagaagtgaacggagttttcatcaggtagattggtttttgtgcggccgtcctccaccgtttcctccaggacagcacctagtcgtggccggagagtctcagagctgtcagaaagaataagactgattttatgggaaaattaagcagatgctccagtttgagaaacctggatcttcgatctgtttgtgatataaaaccaaggaaaataacctaaagtctgaaaaagaccagaatcgaagtttccttgattcatattttaatgttttgaaatttatactccaggctgggtg

SEQ ID NO: 16219 - DNA, 348 bp, Homo sapiens
taaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtgtccggaggagtctcagagctgtcagaaaggtgagcatttgtacagtgaaacattttgctacacaaaagtgatgtttaggaatactaacaaattattttcaagaataagactgattttatgggraaattaagcagatgctccagtttgagaaacctggatctgcgatctgtttgtggtctctatgaataaag

SEQ ID NO: 16220 - DNA, 536 bp, Homo sapiens
aggttcttttccccagctgtttcttbvtaggttgagtcctgttgcttgattagaattaagtgcactgaaatcctgtgtcagcttctcagtagcacctgagcttttagaaagctattccattcactaagtagtgccatttacaaacttccattagagatgaacagaagaaaactgtttaactggcagagaaatatgtttagcccagagatatgtaaacattgcccctgtaggttgggctcaggaagaagaagagagtcacataacataggagctgggctcagctttatgtcacaataacccctgtaggcagggcccaagcataataggagagtcacatcacttaggtgctaagccaagccatatgtcacaatcttcactgtgaacagggtctgggcataagaggacagtcacatctctgatgggaccatagatacgtcaaaatgacttctgcaggcagggcccaggcaaaagaatcagccaattagctcagcaaacttggattcaatcaaacagttatctaaatagcgactgcagat

SEQ ID NO: 16221 - DNA, 291 bp, Homo sapiens
tcagtgcatctccttctcctctctgcctgcctcctccctcaccgaaggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccaaaaaaaaaaaaaaaaa

SEQ ID NO: 16222 - DNA, 493 bp, Homo sapiens
tttttataatttttttttttaccaaaaacacctttcactttctttayacaccttccatgtaaaactgtttttattttccaaagattactaaagtcatgtgaactaaaaggcattacgctttttacttttaaaatatttaagctcttattattcttaagccaattaaagctctttcatatgtaaacaccacacacacaacatawagaaatatacagacagaagaagatctagtagttgtaatatttttcatttgccagtttcttttctddtyytctttcttkkyytttttcctttgagactaagtcttgctctgttgcccaggctggagtgcagtggcgtgatctcagctcactgcaagctccgcctcccgggttcatgccattcttctgcctcagactcccaagtagctaggattacaggtgcctgccgccatgcctggctaattctttgkgtttytagtagagatggggtttcaccatgttaaccaggatgg

SEQ ID NO: 16223 - DNA, 460 bp, Homo sapiens
gcaacagggccgactgcagctggaagatggcggcgtccgtggtctgtcgggccgctaccgccggggcacaagtgctattgcgcgcccgccgctcgccggccctgctgcggacgccagccttgcgagtacggcaaccttcgctcaggcgctccagttcgtgccggagacgcaggttagcctgctggacaacggcctgcgtgtggcctccgagcagtcctctcagcccacttcacggtgggagtgtggattgatgttggcagccgttttgagactgagaagaataatggggcaggctactttttggagcatctggctttcaagggaacaaagaatcggcctggcagtgcctggagaaggaggtggagagcatgggggcccatcttaatgcctacagcacccgggagcacacagcttactacatcaaggcgctgtccaaggatctgccgaaagctgtggactc

SEQ ID NO: 16224 - DNA, 585 bp, Homo sapiens
gagcaagccctggtggcagcgcagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaagtccttcgataamaacatcgtaaagatgtgtggcacatatgagcatcgttgtggagttctggctggagaaagacgagtttggccggagggatctggtgatagggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatctcgggcagctggatgtga

SEQ ID NO: 16225 - DNA, 498 bp, Homo sapiens
acagctgcccgggactccagtgatcgccgcggctcgctcgcgccccggaaactgccccttctcgggggtcatgatgggcagcaagatggcgtctgctagtagggtcgttcagtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttccctaatttatgtatcttggtcagcttct

SEQ ID NO: 16226 - DNA, 299 bp, Homo sapiens
aattacatcccaaacatttctgataatggaagcattttctctctaaaggggatgggattattggattggcaatttctcttaatctgagaaaactcatctcccactcccttccccatatcccctttccatcctctcactcacgcacacgcacacacacacacacactccattcactgtctccatgactctggagtaaactaacgtctcgagttgccattggaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16227 - DNA, 300 bp, Homo sapiens
aattacatcccaaacatttctgataatggaagcattttctctctaaaggggatgggattattggattggcaatttctcttaatctgagaaaactcatctcccactcccttccccatatcccctttccatcctctcactcacgcacacgcacacacacacacacactccattcactgtctccatgactctggagtaaactaacgtctcgagttgccattggaaaaaaaaaaaaaaaaaaaaaaaaaaaaaaaaarrgaaaaaaaaaaaaaaaaaaaaaaaaaaaaaaaaaaaaaaaaaaar

SEQ ID NO: 16228 - DNA, 409 bp, Homo sapiens
acattctcccatttggatttttcaaagacaacatctaatcatccccagagaaatttcagctgagaagacaggatggtgagacagttcctaagtctttcctagacacaattgtctttgcaagtcctctgccacagtcaaagatgaagtgccctgggggccagagtccagacaagtattttggcacctccaaggactcgcagaacacagagaagaaaagagagaccctgttatctttccgcagggtggccgttcaaactctcagagatggaagttaagatttcctttggtataagtggcagtttgactggctgcaaggagagcctcagtttgtttaatttggagtaaaattttatgagttaatctctagtgagggaaagcagcagtaaacacagaacatactggtcattaa

SEQ ID NO: 16229 - DNA, 416 bp, Homo sapiens
attgaaaacttactgtgctcaaggcacagaacggggtagttttatacacattctcccatttggatttttcaaagacaacatctaatcatccccagagaaatttcagctgagaagacaggatgatgaagtgccctgggggccagagtccagacaagtattttggcacctccaaggactcgcagaacacagagaagaaaagagagaccctgttatctttccgcagggtggccgttcaaactctcagagatggaagttaagatttcctttggtataagtggcagtttgactggctgcaaggagagcctcagtttgtttaatttggagtaaaattttatgagttaatctctagtgagggaaagcagcagtaaacacagaacatactggtcattattccaaaaaaaaaaaaaattgcgaaa

SEQ ID NO: 16230 - DNA, 516 bp, Homo sapiens
tgaagaattacttgttcacgaattgcataaagctgcacaggattcccatctaccctgatgatgcagcagacatcattcaatccaaccagaatctcgctctgtcactcaggctggagtgcagtggcgcaatctcggctcactgcaaactctgcctcccaggttcacgccattctcctgccacagcctcccgagtagctgggactacaggcgcccgccaccaagcacagctaagttttttatttatagtagagacggggtttcactgtgttagccaggatggtctcgatctcctgacctcgtgatctgcctgcctcggcctcccaaagtgccgggattacaggcgtgacaccgcgccgggcctgatttcagtttcttccagcccttcctattgttaacatgggggttgtgttgaagaatataaagttacaaagtcaaggaagtaggaaacatttttacaagtattatgtagccatcttggtggggctgtggtgaggtaggsctgcaaatgattctcct

SEQ ID NO: 16231 - DNA, 483 bp, Homo sapiens
ctttttagctagtggccaagattcgcaaagcctcgcggcgaggaaagcacgagtattcaagcgcggctgaggccctccttggctagtgctgggacatggagccccggcagccaaggccaaccttgtgcattccgcccacgtaggcgcctggggccctggtcttcctcgactgcctctccactgcctggaggtcatcaaatgcccctggaccacctcctacgtgccacacgctgtgttggccatccaaggttccatattgagcataaaacagccctctgccctaaaggagttaacctgttggaatcacatacaaaggattctgactaccaagcgccttgaagttaagttgaactctgaagacagattgcctggctacaaagctcagttccactacatatggtccaggaacttaagacaaattattttaatgtctttatgtttcactatccgctgtagtgaaatagaataatacctactcatggc

SEQ ID NO: 16232 - DNA, 385 bp, Homo sapiens
ctaaatatgtttttggaagaaaccaaagaaagtgaagacaagagttctcagcagccccttcaccctgtaagccagcgagggcagccattgtcccgtgtccccaggtgagtcctgcttatggagctggatggaccagcggastargagtcaggtctggctagcaggccagtggagggaggccagcgggacacagaatagaggtggagacagtggccaccacaggagccccccagctgggcacagggtgaccaccccagggtcccccgagctctgtaagggactgcccctccatggatgtcctggccccacagagaggaccacagcatcactcaccatctagggggacgccaggsccgtccctgttctcagcctctccttgggtctc

SEQ ID NO: 16233 - DNA, 161 bp, Homo sapiens
aatgcaacagtacagctccacctggaagcagccccccaacttccccctccaatactgccctccacccgttttctagagttcttgaccatcattttgaaaagatttattaaaactagctaaagacttcatctcaaaaaaaaaaaaaaaaaaaaaaaaaaaaa

SEQ ID NO: 16234 - DNA, 182 bp, Homo sapiens
aatgcaacagtacagctccacctggaagcagccccccaacttccccctccaatactgccctccacccgttttctagagttcttgaccatcattttgaaaagatttattaaaactagctaaagacaacagaaaaaaaaaaaaaaaaaaaaaaaaaaaaaaaaaaaaaaaaaaaaaaaaaaaad

SEQ ID NO: 16235 - DNA, 464 bp, Homo sapiens
acttctcagtttaatccggtctgagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccgagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataac

SEQ ID NO: 16236 - DNA, 598 bp, Homo sapiens
ctcatttggtggtgtctccagcggctcagcagctcctcctttgtgtgtctggacaaactctggtttacaaatatattcttttttttggtctagaaatctcggttttgggtctcgaatgccggctctgtttcgcaccctgctcaattctgaccacaggctccaggccagagcatcaccttggccatcaggggccagctcatcttcagatgttgaactgtgtgaggcagactcagctcccaagcctgtctcaggcagcaggcagcccccgtgtgctggccatcccagctagcaggctggggtcctagagaatcgctaacctcaaggaaaacagcctcctgtcgccgccacctggagacgctcatccagcagggtctgttctctctgctggagaaagccaccctggctgcaaggttcagcggcggccgccgggggcagcacgcaccggattgcaacatgcgatgctttaaacctggtctgccgccagctcttcagatgcacagagggctacaaacaaccacaattagctttcagcacaacagccaccgtctgcgttaatgcgagatgaaccgcagtctttcacagagagagctgcgtgggg

SEQ ID NO: 16237 - DNA, 249 bp, Homo sapiens
attctggaaagagagatttccaacctcttgcatcccctcctctagggctcatgggacctctggttctgaatgcatattcccctaaaatcaaagaacttgaagaccgaaaaagaccatggttattgtcaacttaagtggtctccaagatgggctataagacaccagattgaagtgagaccttagtggctgacagagaacctaaaccctggcttgcaactcgaggctgtgtgaaaggaatcggaacttact

SEQ ID NO: 16238 - DNA, 124 bp, Homo sapiens
ctggaaagagagatttccaacctcttgcatcccctcctctagggctcatgggacctctggttctgaatgcatattcccctaaaatcaaagaacttgaagaccgaaaaaaaaaaaaaaatgcgaa

SEQ ID NO: 16239 - DNA, 87 bp, Homo sapiens
ctbraaagacabmtttccaacctcttscatcccctcctctagggctcatggbacctctggytctgaatgcatattcccctaaaatcw

SEQ ID NO: 16240 - DNA, 122 bp, Homo sapiens
ctggaaagagagatttccaacctyttgcatcccctcctttagggctcatgggacctytggttctgaatgcwtattcccctaaaatcaaaraactkgarraccgaaaaaaaaaaaaaaatgcg

SEQ ID NO: 16241 - DNA, 317 bp, Homo sapiens
agtaaccggccccatcctgccgcgcaccagcctctggtggttatgctctgaagagaccaagtctccagctgaagtggcccagccctttagcagtgtccagtgtgtgctggagccagctcctgcaggcttgcaagccgacggtgcacccagctggtcccaactctgagctcagtgatgtggagccgtagttgaaagtggccacgatgggagaatttacaccacagcaatggacaaatgctacaaaccaaagctccctgcacccagtctgaccccaataaaactggcttgccagcaaaaaaaaaaaaaattscgaaaag

SEQ ID NO: 16242 - DNA, 97 bp, Homo sapiens
ttgaacacatttctgataagagctttaggaggagagaatagagagattggaggaaaggcaaaacttagaattttccaaaaaaaaaaaaaaaaaagct

SEQ ID NO: 16243 - DNA, 502 bp, Homo sapiens
actgacacagtgcttcacaggctgaaggtgaaggggaatggcagtgatccacttttaaaaagttctcttgtagctagtatgccaaaacttttaagagaccatgtgcaaccctccagagccctatttgttggctacaaggacctggaagccacatgtggagatggtggaatcacaggcatggcaatgaaggcagatgcttggtgggctgtggcaagtcaaaagccttaatacgatgacaacagcacgtcaacttctctttcagcatgaaaacatgctacagaaataggctaaagagtagtcttcattggaagtcacctttgaaaacagaacgtcacttttgtttagcactgcaatactcttcaccactctccacttgggttctccctgttttgcacactgtaagaaaatgaattaaccaattaattagccccctgtggctgagttcttaaactctagaaggggtacagagagatcctacctaccctatggatggcagaaatgg

SEQ ID NO: 16244 - DNA, 401 bp, Homo sapiens
tcatgcaccccaagggcctccacttggcctgaccttgctgcgggggctctctgtccccaggaacagtagagatggcaatcttatcgagaccctctctgcccagctgcctctgctccttcctcctcctcctcctcctccaagtgtcttccagctatgcagggcagttcacaaggtcaggagatcaaaaccatcctggctaacacagtgaaaccccacctctactaaaaatacaaaaaattagccaggcgtggtggtgggcgcctgtagtcccagctacttggaaggctgaggcaggagaatggcgtgaacccaggaggcggasttcagtgagctgagatcatgccactgccctccagcctgggcaacagtgtgagactctgtctcaaaaaaaaaaaaaaaaa

SEQ ID NO: 16245 - DNA, 496 bp, Homo sapiens
aagtatcggatccggccttcttcagctctctgttgtctccatcagctcccctggggcactgtgacatttccgctgtgagactgtgtcgccgctgcgcgtcatcacgtgtcgatggaggcatcgcaatgcaacagccaactctagagatgcccaatgcacaagactcccgatggaaagagaatgccgatggagttgggctgccaggccttttctcctaggttgcagcactggtggagaggagaggcatctggaggaggggagccatgtcaagcgcgtatgagcacacaccttctctctcgggtcctgggttcctttttgagccgtggatgagaaaatgagaggcgtaaacaggactgatttcaaacgttctgcctaactatcatggcaaagagaaggaagtcatcccctagagtgatgaactagcttcttcagaactttcttggaattgagaagaaaatttaattaatccagggttattaaatggattattactaat

SEQ ID NO: 16246 - DNA, 337 bp, Homo sapiens
aagagtactagacataactgccctcacagcactcctgatatgtgacttatcaccagatcctgcgattgctgacagcggtgcacagaacagtctggaatgttgctagggacaggcagatggaaaggatactgcagagaagaccaagaaagagaaataggaagaaaatgcagagtgggttgtcatggaatcttcaagaaggaagctcattgcctgacccacttgtttcataatgcaatgaaatgctaaagaattttaactccataaggaaaatcagggcaagacaataaaagaaacattaaatattagtaaaagtacgaaaaaaaaaaaaaaatgcgaa

SEQ ID NO: 16247 - DNA, 239 bp, Homo sapiens
ggttacaggacgtggcagctggttggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcgaaaaa

SEQ ID NO: 16248 - DNA, 631 bp, Homo sapiens
cttttccctggtgtgattccgtcctgcggcgggsttgttctctggagcagcgttctttttatctccgtccgccttctctcctacctaaagtgcgtgccgscaaccgaatkggaagattcggatggacatggacatgagcccccttgagggccccagaactatcttttccggttgtgaactaaaggccgacaaaagattatcactttaaggtggataatgatgaaaatgagcaccagttatctttaagaacggtcagtttaggggctggtgcaaarggatgagttgcacattgttgaagcagaggcaatgaattacgaaggcagtccaattaaagtaacactggcaactttgaaaaatgtctgtacagccaacggtttcccttgggggcttttgaaataacaccaccagtggtcttaaaggttgaagtgttggttcaggggccagtgcatattagtkggacagcaacttagtagctgtggaggaaagatgcagagtcagaaagatgaagaggagggaggatgtgaaactcttaagtatatctggaaagcggtctgcccctgggargtggtagcaargktccacagaaaaaagtaaaacttgctgctgatgaagatgatgacgatgatgatga

SEQ ID NO: 16249 - DNA, 63 bp, Homo sapiens
atccctggtgtgattccgtcctgcgcggttgttctctggmgcggctttcttttatctcygtcc

SEQ ID NO: 16250 - DNA, 56 bp, Homo sapiens
atccctggtgtgattccgtcctgcgcggttgttctctggagcggctttcttttatc

SEQ ID NO: 16251 - DNA, 63 bp, Homo sapiens
atccctggtgtgattyygtcctgcgcggttgttctctggagcggctttcttttatctccgtcc

SEQ ID NO: 16252 - DNA, 445 bp, Homo sapiens
  misc_feature 380,384: n=a, g, c or t
aatttcccatctttcttttcagtccttgcgcaccggggaacaaggtcgtgaaaaaaaaggtcttggtgagcgtgccgccatttcatctgtcctcattctctgcgcctttcgcagagsttccagcagcggtymtgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcnttgngtggatcaaactagaactcatatgccatactagatatgtttgtcaataacttatgacgcaa

SEQ ID NO: 16253 - DNA, 63 bp, Homo sapiens
  misc_feature 41: n=a, g, c or t
atccctggtgtgattccgtcctgcgcggttgttctctggancggctttcttttatctccgtcc

SEQ ID NO: 16254 - DNA, 147 bp, Homo sapiens
cttttccctggtgtgattccgtcctgcgcggttgttctctggagcagcgttcttttatctccgtccgccttctctcctacctaagtgcgtgccgccacccgatggaagattcgatggacatggacatgagccccctgaggccccaga

SEQ ID NO: 16255 - DNA, 56 bp, Homo sapiens; identical to SEQ ID NO: 16250

SEQ ID NO: 16256 - DNA, 56 bp, Homo sapiens; identical to SEQ ID NO: 16250

SEQ ID NO: 16257 - DNA, 56 bp, Homo sapiens; identical to SEQ ID NO: 16250

SEQ ID NO: 16258 - DNA, 369 bp, Homo sapiens
gtcgggaaatggcggccgcggccgggctggggcttcagcgggaggcagcagaggggaagtggtcagcgtggcgaatgacggragaaactcgcattgkctactggatcaaggacagacagctcaccaaccgtgacagsaccatactggaacttcaaaaagttctgaaaacatgttgtgctcagagcatgaaaattttctgctgtctttggaactttgtctacaaacagttagaagatgcagcccaagggctcaccatgggtggcgatgttgaagaacatgaagaccttactgctgatagcaccatcttcaaatttgtggaagcttatgtgagttggataggaaaattkcctacatataatgttggctctt

SEQ ID NO: 16259 - DNA, 57 bp, Homo sapiens
atccctggtgtgattccgtcctgcgcggttgttctctggagcggctttcttttatct

SEQ ID NO: 16260 - DNA, 56 bp, Homo sapiens
atcsctggtgtgattccgtcmtgcgcggttgttctctggagcggctttcttttatc

SEQ ID NO: 16261 - DNA, 64 bp, Homo sapiens
atycctggttgtgattccgtcctgcgcggttgttctctggagcggctttcttttatctccgtcc

SEQ ID NO: 16262 - DNA, 147 bp, Homo sapiens; identical to SEQ ID NO: 16254

SEQ ID NO: 16263 - DNA, 322 bp, Homo sapiens
aattattacggtcatataaatgatgagagstaatgaacttcagtgatcagaggaaactattaacagtgataatataataatactgatttattctcacttgagttttttccttaaggtctgacaccatgccaatttccacagacctgtaactttaagttaccttaagctgggcctggtggctcacgcctgtaatacaagcactttgggaggccgaggtgggaggattgcttgagaccagcaacaacatagtcagaccacgtttctaccaaaaaagaaaaaaaattagcctggtagtgcacgcctgtagtaccagctasttggg

SEQ ID NO: 16264 - DNA, 226 bp, Homo sapiens
taacagttattctaaaaatatttcttataggggagaaaatgtaatcagtatattgtatgttttagtctggtgtggtggtgcaagcttgtgatcccagctactcaggaggctgaggcaggagaatggcttgaacccgggaggcggaggttgcagtgagccgagatcgcgccattgcactccagcctgggcaaaagagcgaaactccatctaaaaaaaaaaaaaaaaa

SEQ ID NO: 16265 - DNA, 490 bp, Homo sapiens
ttattctacaatgtgtagataattattactattttcatgcattttcttctagtttttttctttaccctgcgtaatattttattttatttttttgagaccagagtctcactctgttgcccaatctgaagtacagtggcatgatcttggcttactgcagcctccccctcccaggaggatagcttgagcccaggagtttgaggttatggtgagctatgatcacaccagtgtgctccagcgtgggtgatacagagtgagaccctgtctctataaagtgacaactacaaaaacaaacatttgctgacataatcacaatgtcattgttacactttacataattgacaacagttctctgacatcagctggtcatgtcacctctcctagatgggccacagaagtctttctagacttggtttgtcacctcaggacccagtgagactcacacattcattatgtttggctgttaggctcttaggttccttttaactagggt

SEQ ID NO: 16266 - DNA, 353 bp, Homo sapiens
cggctgtgctagacgagtggtgaagcccaagtatggagtaacgtcattaattctttcattcacttattcgaatgcttgctgagttctgtgttgctactggtttagttcttgggatactgcgagtgaacagttggcggcgaggctgttgttgcaacgtcagagtaaaagaaggaccctgcacggcggcctcccagcacttcgggaggccgaggcgggcggatcacctggtctcaaacttctgacctcaggtaacccgcctgcctcagcctcccaaagtgttgggattataggcatgagcctccatgcccggcaggatattatattaaagaattgttgtatactttttttttttt

SEQ ID NO: 16267 - DNA, 461 bp, Homo sapiens
agaaacacctaataagagtaaaggcaaagagttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctgtactgtctttcaggttcttatgcctttgtttgaaaaacatggttccctgtgaaattttacacgtagaagaaagcttcacactacgagagctctcaggatataattatttcagacagatactgggaacataagatggcttatcaatctaagatg

SEQ ID NO: 16268 - DNA, 451 bp, Homo sapiens
  misc_feature 251..253,285..286: n=a, g, c or t
actttacgactagcgggagggggccgggctagcgggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctgggttcttatgcbwttgtttgaaaaacatnnntccctgtgaaattttacatgtagaagawagcnncacactacgagagctctcaggatataattatttcagacagatactgggaacataagatggcttatcaatctaagatggccttcctgtccttcggattgaactgaaaccatccctggttccggggataggtaggtgatccgggtttggacaatcaaagtgttgagc

SEQ ID NO: 16269 - DNA, 430 bp, Homo sapiens
aaaaaaaacttgatcctttattgtggtagaagcatagggcatgttggagatgcagtagacatgctggcatggctggttataccaaggagtacataacatagctaacatgtattagacatgtattatgttttacgtactgtcctaaatatttcatacatcttttaaagtttgccagaaggaccctgtgaaacagtattattatgtacttcattttccagatgttaaaaattaggaagatcaaataatctgctcaagctcaggcctgggtactgggtgacagagggtatactcttaaccagctcatcatgctacctgcatgcaacacaaggagttattggataggcacatgaggctggaaaaggtagaagattctgaggccctgggcgggaactagtaagccacaatctggaagagtcttttaccaccatgt

SEQ ID NO: 16270 - DNA, 408 bp, Homo sapiens
cttaggatttgaacttttccttgtagacagtgggaagaaaagggagtgttttaagccaaatagtgacatttgtgtttcagaaattcaggtaggcagacgtgtggagaatcactatgaggggaggccagtcacgctattccaaagaggctgaaggctggccgagattagggcagagggggtaggcaggctcttcagccagagtggtgtgttagaatcctggttctgccagttggacattaagctctccatctctcagttttgtcatctgtaatgtggagatattaagagttcttggccgggtccagtggctcacgcctgtaattccagcagtttgggaggccgaggcagacagatcacttgaggtcaggaagtttgagacagcctggccaacatagcaaaacttgtctc

SEQ ID NO: 16271 - DNA, 508 bp, Homo sapiens
cttaggatttgaacttttccttgtagacagtgggaagaaaagggagtgttttaagccaaatagtgacatttgtgtttcagaaattcaggtaggcagacgtgtggagaatcactatgaggggaggccagtcacgctattccaaagaggctgaaggctggccgagattagggcagagggggtaggcaggctcttcagccagagtggtgtgttagaatcctggttctgccagttggacattaagctctccatctctcagttttgtcatctgtaatgtggagatattaagagttcttggccgggtccagtggctcacgcctgtaattccagcagtttgggaggccgaggcagacagatcacttgaggtcaggagtttgagaccagcctggccaacatagcaaaactgtctctactaaaaataaaaaattagccaggtgtggtggtgcatgtttgtaatccccactattcgggagagaattgcttgaacctgggaagcagaagttgcaatgag

SEQ ID NO: 16272 - DNA, 519 bp, Homo sapiens
ataattttattggactgtttgtctttgttctctgcctcttgtattctagcatccgcacttccactaatagccaagtagacaagctgaccctgtcaggagtgacagcgtcatccttggtgatacaactaccagtggtgccagtgatgaagaagatggacagcctcggcggctgtkgacaackagaaagagggagtgcagtatagctactccttattccacctcatgctctgcttggcttccttgtacatcatgatgaccctgaccagctggtacascctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttg

SEQ ID NO: 16273 - DNA, 450 bp, Homo sapiens
gtatttaggacagttgtcctcacccgtgtgtaccgagcactgggagtctgagctgggagggtgtgcaaggaacagatgcagcggatcccaaaggcacccacggaaaatgggcagggtttagcacattccagttgaaggagaggaaggagttgggaatgataccctgggtgtattagtttgctagggctgctataacagtaccataaactgggtggcttaaggaacacaaccttcttgcctcacagttctggaggctggaagtacaagatcaaggtgttggcgctgttggttcctgtgagggctgccagggagggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcg

SEQ ID NO: 16274 - DNA, 337 bp, Homo sapiens
aagaaatgggacttaactcaaaaagaccttcttcaggtaatgcagaaccttttcatggtatagagtgggcatttcaacacaatcctgtagcctgtagaagaacttgaagagcttctatgtagatttttatcatttacagataatattaatcaggcctttttcttaaagaatgtttcatcctccccagagttcttcactgggagaagggaaacagtcaacattgaataatacccgctagataagagaagaagagatgctgataagagttgaaagatctagggttgctccatgcatgtgtttattaaataaaatcagcctgggagtagagcaaaagagg

SEQ ID NO: 16275 - DNA, 552 bp, Homo sapiens
tatataggcagttgcatgctagcatgggtatttttataacaatataactgagttatattggaattataaatattttcsgtcacttaaatttgttctttgtttagcctgaaaacctttatggctcaagatcagattcctgactaacccctctcttagagctacagcagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatg

SEQ ID NO: 16276 - DNA, 459 bp, Homo sapiens
tatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtgacccttccctttttctctagctggatctgttttcttcccttcgggcccccatgttttcctgcacccgccctaccatggtctctctctgcagttatttaatgcctgtgtcagatctactgtaaaaagacgattaagtaaaataaaatgg

SEQ ID NO: 16277 - DNA, 412 bp, Homo sapiens
ataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttggaaaaaaaaaaaaaaaa

SEQ ID NO: 16278 - DNA, 454 bp, Homo sapiens
  misc_feature 13: n=a, g, c or t
agtctgaggcganttcggagcggccggtactgttgaaagcgacaagtggaggcgccgctctagcgcgggactctgaactatggcgcccagagcacatgtgaggagaggcagaccatattttgcagagcactgtgccaaggggctgttttcattaaagagggttaatgacattaagatgaggttctcacttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataa

SEQ ID NO: 16279 - DNA, 459 bp, Homo sapiens
aaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaacccgttttagcctggatatctctcctaaagagccttctctgactcccaggactctcgggtactcccacttttctacccttcgcatcacccaccaattgaaagcgcagtgctgtgcgcaataagcactcacatgcttattgagtgtgttgaggaatgagttattctccccacctcagaagtaccagcttttggtgtatcatgcagattctctctttcatgataaggaatatcggaatgctgtgagtaaagtataccatggctttacagcagaagaaagcgctaagtaaaacttcaaaa

SEQ ID NO: 16280 - DNA, 422 bp, Homo sapiens
aacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagaaaaagaacagcctaaagaaatggcttgagaataaccac

SEQ ID NO: 16281 - DNA, 268 bp, Homo sapiens
ccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaaggttctactgtcacccaggctggaatgcagtggcgagatctcggctctttgtaacctccacctcgc

SEQ ID NO: 16282 - DNA, 506 bp, Homo sapiens
caaacacctgggccttctraggtccaagcaatcagacaaagagcaccgtgagggaggtcacactctaggtcagggtgaaagacagacagacacacgtttaccctctctccttcctcatatcccactgaagagacacgattcacagaagagaataagtccacagcagatgagaagtgaggtgggcagaatcagcctacagttcgaataattttttttacgattgaaagcaaatgataacctatgatagatgaaccagaataaaggggccatatcctttaatacggggtacagaagaagctggaatcagagatgagagccattcttggtggggcagtcccaccaagcaccaaaggatgaataaaaagactctcagccctagagacaaatttgtgaaattgaaaatgaaggataaagaaaagaccatataaccttccagagagagaacaacagattacctgtaaagaacaggagtcccatgaagacagcactcttctcatcagcatcag

SEQ ID NO: 16283 - DNA, 210 bp, Homo sapiens
agtatcgcggacggaagatggcgtccgcacccgtctcatccagcggctgcgaactgggcgtccgggcatgacctgcaggggaagctgcagctacgctacagggagaatgtgacctaatttatgacaaatacgtagagctcaggtatcacttctagttttactttaaaaaataaaaaaatagagacagagtctcaaaaaaaaaaaaaaaaa

SEQ ID NO: 16284 - DNA, 441 bp, Homo sapiens
agttcacagctgccctgttgcagggaggcggtggcccttctgttactagaccgagcctgtgggatataccaaggcagaggtatggatgagagaggcagctgcagatagaagtggtcacatgcaggatgtattttgaaagtagacctggccaggtcgtggctcaggcctgtaatctgagcactttgggaggccaaggcaggaggatcacttgagcccaggagatcaaggctagcctgggaaacatagcaagaccctgtctctaaaaaaataaaaaattagctgggtttggtagtgcatgcctgtagtcccagggacttgggaggctgaggtgagagaatcgctttagcctgggaagtcatggctgcagtgagctgtgatcacgccactgcactccagcctgggcaacagagcaagaccctgtctagaaaaaaaaaaaaaaaa

SEQ ID NO: 16285 - DNA, 492 bp, Homo sapiens
acgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcatccctgtgggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcastgcggggtctggatcgagtctgccctctccgttacctaa

SEQ ID NO: 16286 - DNA, 461 bp, Homo sapiens
acgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcagtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcgg

SEQ ID NO: 16287 - DNA, 512 bp, Homo sapiens
gcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcgggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtatctcgattgccaaaaagcaccaagaaacatgccatagggatttatttcaatgacgatacctccaagacttttgcttgcgaatcaggatcttgaggctgatgagtggtgcaagtactc

SEQ ID NO: 16288 - DNA, 246 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaaaaaaaaaaaaaaaaaaaaaaaaaaaaaaa

SEQ ID NO: 16289 - DNA, 200 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaa

SEQ ID NO: 16290 - DNA, 198 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaa

SEQ ID NO: 16291 - DNA, 249 bp, Homo sapiens
agcattcatagaacagttatcttgatagttggggaattgtttacagtctagatgacattaggcctggtgacaattcaraaggcagtacctctaatacttaagacttagaccaatattagactaccaaagtcatccttggataattgggagcatagtctaacaagaaaaatgascggtaacactaatagctgaaaaaaaaaaaaaaaaaaaaaaaaaaaaaaaaaaaaaaaaaaaaaaaaaaaaaaaaah

SEQ ID NO: 16292 - DNA, 249 bp, Homo sapiens
agcattcatagaacagttatcttgatagttggggaattgtttacagtctagatgacattaggcctggtgacaattcaraaggcagtacctctaatacttaagacttagaccaatattagactaccaaagtcatccttggataattgggagcatagtctaacaagaaaawtgagcggtamcactaatagctgaaaaaaaaaaaaaaaaaaaaaaaaaaaaaaaaaaaaaaaaaaaaaaaaaaaaaaaaah

SEQ ID NO: 16293 - DNA, 222 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaaaaaaa

SEQ ID NO: 16294 - DNA, 259 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaaaaaaaaaaaaaaaaaaaaaaaaaaaaaaaaaaaaaaaaaaar

SEQ ID NO: 16295 - DNA, 217 bp, Homo sapiens
agcattcatagaacagttatcttgatagttggggaattgtttacagtctagatgacattaggcctggtgacaattcagaaggcagtacctctaatacttaagacttagaccaatattagactaccaaagtcatccttggataattgggagcatagtctaacaagaaaatgagcggtaacactaatagctgaaaaaaaaaaaaaaaaaaaaaaaaaaa

SEQ ID NO: 16296 - DNA, 363 bp, Homo sapiens
tttgatggagaaacctggaagcataaatcagattgtctccagcccaaagggaaaaagactgtaagaatagtcttattctctttagaagctggaatttaaaggaaagaaaaagctaggcagtaactagtggaaaacacagggtatagacaagatctttataaagaggggaatgacaagaatatttacaaactgagaggaaagagccacttgagaaggagccatctgcggtgtcggagcagagtgatagtccctgggggcctaaggaactccagaggattacagctcaagagtgggccactttttccaccgagatacgccagtgggaaaatgtgtttggatggtaggggttggggtatagggaag

SEQ ID NO: 16297 - DNA, 575 bp, Homo sapiens
ataagaaaatgaggaaccagagagagatgaaaattttcccaatgtcctaagattatcacactgcatcataactgcccagtaatttttccatctccctcattaacctctagaagccatatgaaggtggttggaaatcccggacccccggtccaccagccttggcctcctgcagatgctaggctcaggatgaagtgcggccgaagactgctgggaaaagaaaagaaagagccctaatgtgccatatcgggcaagccgtggggtggcccactaactgcttttttatgattgtcacttactggctctgatttaaccccacttaaagagtggtggcagcaattgtggagggcctcaaagggagactgatgcaagtgagggcaaagtattattgggaacgaggtcaaatgggtgatgaatgggccattatgaggaggggcaaactgccatcgttagggatgctgcaacaagctggacgttgatctattgtccgctctgagatcctccaacaggccattatggctcccctaatgagattgtcatgcatttctttttatgtagctattaaaatcttgtctaca

SEQ ID NO: 16298 - DNA, 319 bp, Homo sapiens
tttttagtggaaagctgtagcagaggataagggtttgggaatagcgttaaaggtcatgacttatttctcagtttttatggaatttttcagtaaaaagacttgaccgtcaaagaaaaggaaactgctgttatcaagttgagccccatatgggggttggcaggcagcagagaggcccctttcaaggtgttcgggtaaagaactcagtgaaggaactcctgttgcacatccgaagtcataaacagaaggcttctggccaagctgtggatgattttaaagacacaaggtgtgaamattagaacagttccagagaatttgaagg

SEQ ID NO: 16299 - DNA, 491 bp, Homo sapiens
attgacttcagttaggactctagagagatccaggtggcttaatctccattttcggactctggattctgcttgttcatctcagtttgcaaacatccttgtggccttacttgtctttctgccaaactacaaatgcatgatccaatatgtcattatgttctgatctgcaccctggaatgtcatccctttgaccatctgccacactccttcctacttgataatcttaaaatcctggataaatacagtgtccattgtctatttctgctttggattcacaaataatgctgatacaaattataaccatcttaactgattccacctagtatatagaaaaatttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgg

SEQ ID NO: 16300 - DNA, 474 bp, Homo sapiens
acacccagaaggtggagccccggccgggttacgcggaccacccagctgtctggagaggtaagaactgttcgtctctttattatacagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaagggagttgatgcctccgaacagagtaatgtcgctggagacactaagcatcgtcggcccctggcgagctccctaaatatgtgttggatggatggaagaaaggatggatagttcagagtacttcagccttgattcctccgcaacagacacctgaaacttgaccctacattggttcttggccatcgtgatcttccttggacagaatcacctttcagctccggtcatcagactttccagggcctcagaaagc

SEQ ID NO: 16301 - DNA, 449 bp, Homo sapiens
ggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatggtaacatttcttcgccctacagtacagcattcaaaataagcctttctatttataatccagatcaccaaagaggtttctagataatttaaaagtccacttttaggcttgattattttaaaatgcttatatgtcagatcttcagtttgaccagttat

SEQ ID NO: 16302 - DNA, 585 bp, Homo sapiens
acatgtaggctatatgacacagcccattgctcctaggctacaaacccgtgaagcatgttactgtgctgaatactgtaggcaattttaacacaatggctggtcttgaattcctggcctcaagcgatcttcctgcttaagcctcccaaagtgctggattacaggtgtgagccaagaggcctggccagatgggtatgtcctggactggcatctacaaacaactgctttctatacaatatctatgcaagatctagcagagaaaaatgagatgtgggaaattatttaagcaccatagtagaccaaatgagatggacaagccattaacagaatatggtgggaattagatttaaataaaatcaattctacaatcttgtttggtttttcacatcactaacattttggaagagtgcagaggataacctacgtattttgttggaaacaaaccagatgatcttgaatttgttccaaggccaccagcaaaaagcatgatgaaagaaatgattgaaatggtggctgctacacaaagtccctaagtgactattacaaaaagagatgctgctgaccatgatggacatgcaaggagagcaa

SEQ ID NO: 16303 - DNA, 348 bp, Homo sapiens
aggaagtgtttggatattggraaaacaaaaacaaaaaaaaacctttgttctgtaagacagtatagaaagttgggagaaaggtctactccaggatcaaggaactggaccaacggrcccaagggagagtatcaaaggcaaaacaaaggaaaatgaggacaacccaatactcagaaaaaaaaacgagtaattcatggattcacaacgggcaacaaactagatgactattaggaagagaagagcaaaccttatgatctcaaaatgatttcttgttcatttgcatcctcgcatcaatctagactttaagaaatatgtgatttttaaataaatgggtatatctgcaaaaaaaag

SEQ ID NO: 16304 - DNA, 359 bp, Homo sapiens
acttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaa

SEQ ID NO: 16305 - DNA, 300 bp, Homo sapiens
acttcsccgggagccggaagtcscgtstcacgttgcsctggcagcgcgcgaggctggtgagtcggcagccctgtggcagcsggsgggctggtttssatggttgcacgattaggaaccaccagctgctgcatcccatggccaggggtggcgtcsaggtggcagagcagctaggaacgcaaggcctgaacctggggccagacacccctctcccggscatggtcaacgaccctccagtacctgccttactgtgggcccaggaggtgggcsaagtcttggsaggccgtgscgsagstgctgctg

SEQ ID NO: 16306 - DNA, 297 bp, Homo sapiens
aattttgaaaatctgacatcagctgggcagtcgccccctcctcctttcctccctctactctgacacagcacttagcacctgaatcttcgtttctctcccagggaccctccattttccatatccaggaaaatgtgatgcgccacaggtatcagcgtctggatcgbcacttcacgttttagccacaagtgactcagtggaagatccagagtcaacagaggctcgtcaggaagatgtctacagaaaaggtagaccaaaaggaggaagctggggaaaaataggtgtgcggagaccagatca

SEQ ID NO: 16307 - DNA, 495 bp, Homo sapiens
tcaagcctttgttatattggattatcttctctcttaaaatacaactgtattataattgaaatgacagcccaaaattggatggtttaccaaaaccaatgaaagggatttcacacatcaatttttatttctgttttgaatagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaa

SEQ ID NO: 16308 - DNA, 457 bp, Homo sapiens
ggaagttccggtgtccgcggcgctgggtcggtggcggaggctgaggagaaggaggagcgggccgtggaggcttcgccgcctaggtactgctataaccagaatttggtagaaaaagratttacttgttggggccctcttgataaaaagagatgtggggggatyctcgacctgctaacagaactggaccttttcggtaagttctcaaatttgaatattgaaattgccagtattttaattataaatgtgtaacattttcgcctactataaatgaagatattttctctgtggagaaatagtttctgattttttaaaaatagaartttggctgggcgcggtggctcacgcctgtartcccagcactttgggaggctgaggcgggcagatcatgaggtcaggagatcgagaccatcctggctatcacggtgaaacccgtctctactwaaaaatacaaaaaaaa

SEQ ID NO: 16309 - DNA, 176 bp, Homo sapiens
agggtgctgtagagaagaatgaagcaggaaggaggaattgggacagttagaactccacagaatgaatatattgaattacaccgtaaacgctatggataccgtttggattaccatgagaaaaagagaaagaaggaaagtcgagaggctcatgaacgttcaaagaaggcaaagaaaat

SEQ ID NO: 16310 - DNA, 248 bp, Homo sapiens
catatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagc

SEQ ID NO: 16311 - DNA, 655 bp, Homo sapiens
gctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgat

SEQ ID NO: 16312 - DNA, 542 bp, Homo sapiens
ccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccgagcctcagtccccagcagagcctgtgtctcaccccctcacaggacagagctgtatctgcatagagctggtctcactgtggcgcaggccccgggcggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctccttccactgatttttctgt

SEQ ID NO: 16313 - DNA, 505 bp, Homo sapiens
ccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccgagcctcagtccccagcagagcctgtgtctcaccccctcacaggacagagctgtatctgcatagagctggtctcactgtggcgcaggccccgggcggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaaca

SEQ ID NO: 16314 - DNA, 415 bp, Homo sapiens
  misc_feature 162: n=a, g, c or t
aacacgggaacacccacctttagagatgagacacaagcaggagaagagggattaaacctgctagttttggaaaaaaaaaaaaggaaagaaaagaaaagaaagaaagaaaaacaaaaaacaacaacaaacagaaaawtgcaaaactgcagaacacgcagkranggttggwttcagaggacatggggatcagtgtgggctgtgctggtcaaggagggcttccagggagaggcaactgrggwttcactgcaattgtyccttgagaagatgaggwtcaggtcgggawttggaaacatctgagggctcaattcaacctggcttctaaaacgaacatggkgaacatagatcaactactgaacttcttttaacctckggvatcctatctgkgaattgtggggrggaaacagggtccacccgy

SEQ ID NO: 16315 - DNA, 166 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaa

SEQ ID NO: 16316 - DNA, 169 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaa

SEQ ID NO: 16317 - DNA, 231 bp, Homo sapiens
  misc_feature 231: n=a, g, c or t
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaaaaaaaaaaaaaaaaaaaaaaaaaaaaaaaaaaaaaaaaaaaaaaaaaaaaaaaaan

SEQ ID NO: 16318 - DNA, 174 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaam

SEQ ID NO: 16319 - DNA, 169 bp, Homo sapiens; identical to SEQ ID NO: 16316

SEQ ID NO: 16320 - DNA, 242 bp, Homo sapiens
agccaagcttcacttctaaagtgcctacagagacttgtaaatgaaaatgcagctctgcacgagtttgaaaccgtcatacctcccttctattaggaatggcatatactgaggtggtcgtaagtcttaacttctaaaattttaaataaaagactttgcacattgaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16321 - DNA, 175 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaa

SEQ ID NO: 16322 - DNA, 171 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaam

SEQ ID NO: 16323 - DNA, 172 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaa

SEQ ID NO: 16324 - DNA, 242 bp, Homo sapiens
agccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 16325 - DNA, 413 bp, Homo sapiens
  misc_feature 378: n=a, g, c or t
ttcctggttttaagcctctgttgggaactgggctctcaggcagatgggattgggtacttttgctacttgctgaataactcttggccagtgactttatgtctggacctcagtttattcatgtgaaaaatggacatgataacaatagtcattagatggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccakacccggattgtggccctgaatgcccacaccttcctgcgtaatggangacactttgtgatttccattaaggccaactgcatt

SEQ ID NO: 16326 - DNA, 389 bp, Homo sapiens
aaaaggaataaatagttccggcgcgggtkttgagagcggtgtggtaggtgttgtagccgctatggtgaagttcgctttgtagcggccccggctagagagttggcctgttccctgcctttgtgacccggagagcttttgggaactggtttgtggcctgtttgattcctgtcagaggtttgactgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttac

SEQ ID NO: 16327 - DNA, 587 bp, Homo sapiens
atttataaattgtgtgaagcgaatttcccgtttggcaatcatttactgatttgcagtgatgaatatttttatgagaatttaaacttagcaagaatggccatggaggcaaagcttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttggtgcagataacaacctgct

SEQ ID NO: 16328 - DNA, 559 bp, Homo sapiens
atttataaattgtgtgaagcgaatttcccgtttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccsrggataatttcaaatggaatagagtattttgakattgttcattcagagggtgatgtgtacatatctatattgtatatatgtgatgaaatgcatt

SEQ ID NO: 16329 - DNA, 489 bp, Homo sapiens
ataaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtattaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaaga

SEQ ID NO: 16330 - DNA, 482 bp, Homo sapiens
agaaagatggcggagaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaag

SEQ ID NO: 16331 - DNA, 396 bp, Homo sapiens
  misc_feature 134..135: n=a, g, c or t
acacatcctgtctctgtgtgtggagctggctggaatctctcagcctcacctgccagacaacaccccctccttcctcaccctgtctcctgcattctcctgaaaccttcatccacacaatgcctcccaacctcacnnsctactacssctttgtctcgcagaagaacatggaggactacctgcaagccctaaacatcagcttggctgtscggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacc

SEQ ID NO: 16332 - DNA, 504 bp, Homo sapiens
acagagggtggggcagacgctccgtttccggtggcagggtctggggaagcggcggcaggcgccattgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggatggaattaagaaatctggcaaaaagtaagctgttccttgtgcctgaggagatggtgaccctttatttcatctgtatttaaacctctctattccctgccataacatcttttgccacgtatagctggaattaagtggttgtcttggagctgttggtacatttaagaataaacttttgtaaaaahaagaaaaatcttacagtggctcatcatctctttagttgttttcactaagtcgttcctaccataactgtgaatttaaaggtaaaaaccagc

SEQ ID NO: 16333 - DNA, 146 bp, Homo sapiens
aagaaaacagctaattatatcaccaagagacccagggcatatggtcactctcagctggcccagcctgtttctacttgctttgcatgattgttctggatttttcaaaataataataactaccaaccaaaaaaaaaaaaaaatgcgaa

SEQ ID NO: 16334 - DNA, 487 bp, Homo sapiens
ttcgggtggttctcctgcctcggcctgccgagtagctgggactgcagtcgcgcgccaaccacccccggctagtttttttgtttttggtggagacgggatttcaccatgtttgccgggatggtctcgatctcttgtgctcataatctacctgcctcggcctcccaaagtgctcggattacagacgtgagccactgcgcccggcccgttggcttgctttctagatactgggaatagatcttgttatagtatgtgataaatagatcttgttatagtatgtgataaaatgccatgatcaaataaattacttatatcctgtttggtgatttttagaaaaacatatttatctacatctaaaatacttattttaattttaaacacttgatggtatgaaatgaaattttgttactttaccattgtaactatgtcataaagtcataaagtacctgtccccaaaaaggcaaccagtaaatatttttgagtaaatgaa

SEQ ID NO: 16335 - DNA, 493 bp, Homo sapiens
gaggagtcccacggtgtggcagatggagacacccaggagaaagaagagggcgaattggaagaggccacccagaaaggacggtgtgtgacactagggagccaagcatggagagccgaggactaacgcttggaaggaaatgtggaccagaaggttccggatgagggaaggactggcggctacactctgccttccgagacaacgaggaataatctcacttcagtcagttcaacccttgtaaaacagctactgtgtgcaagacacggagggaaagctgaagtagagaaaccacagacgctgtcttcaaagggtttaatctaatattagtgatgagaaaaatagggtgcagagcttaaggcatcctggaaaaacgtatgtagcgccacatcgcgaaaatctctcttctgggacccctctcccaaaaacgtttcttcgccctcttctcccccttctgcctccactctttctggacttcagatatcttttgagaagcctg

SEQ ID NO: 16336 - DNA, 442 bp, Homo sapiens
acaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacacgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgagttcagcggcttcattcttgaagtcagtaagaccaagaacccaccaattccggacacagtagcatttgggaataataagaattgtagctgggcatggtggtac

SEQ ID NO: 16337 - DNA, 513 bp, Homo sapiens
aagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacrcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaacaatgaatcctccaatgtacctgactctccctttgcgaagagcatctccgtggcagaaatctgaaaatgcccctggggagacacatgcacaagacagtgagtgatgcagccgtttcccacgtatctcacaatgtacttctctggtct

SEQ ID NO: 16338 - DNA, 205 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccmakgggcactggagtgagggagtagataaaacagctgcaatataaacagcaaaa

SEQ ID NO: 16339 - DNA, 212 bp, Homo sapiens
  misc_feature 37,153: n=a, g, c or t
gaccttgatgctgatgagctgatctctgccgcctgcntggtttatgctgagctcatccagaaggatgttcctcagacattaaaggatttcttcctctgaggacaccaaagcccgcagtggactgatgccttcgatgggcaggatgaaggccangggcactggagtgagggagtagataaaacagctgcaatataaacagcaaaaaaaaaaaa

SEQ ID NO: 16340 - DNA, 241 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaaaaaaaaaaaaaaaaaaaaaaaaaaa

SEQ ID NO: 16341 - DNA, 216 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaa

SEQ ID NO: 16342 - DNA, 210 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaa

SEQ ID NO: 16343 - DNA, 219 bp, Homo sapiens
gaccttgatgctgatgagctgatctctgcsgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaaaaa

SEQ ID NO: 16344 - DNA, 229 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagcaaaaaaaaaaaaaaaaaaaaaaaaaaaaa

SEQ ID NO: 16345 - DNA, 221 bp, Homo sapiens
gaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccakgggcactggagtgagggagtagataaaacagctgcaatataaacagcaaaaaaaaaaaaaaaaaaaaw

SEQ ID NO: 16346 - DNA, 239 bp, Homo sapiens
aaaattatttttccctctggggtgattacaaccacacgggagctgtgatgagagatgaaagaactgaccctcaaggagaccaagggataatgaccatgatgatcacatgatagcccagtcaaactggccacttggttctcaaaccctggccttttaagtcaaaattgtattactacactaaatgtaaaatggcatcttaccaaaataaatggaatctttgaagagaaaaaaaaaaaaaa

SEQ ID NO: 16347 - DNA, 314 bp, Homo sapiens
  misc_feature 78: n=a, g, c or t
gagtatgttctagaacttgcttctgtgtttgtgtcttcaaaacagctgctatcaccaataattaaaccataaaaaacngaaattatttttccctctggggtgattacaaccacacgggagctgtgattagagatgaaagaactgaccctcaaggagaccaagggataatgaccatgatgatcacatgatagcccagtcaaactggccacttggttctcaaaccctggccttttaagtcaaaattgtattactacactaaaacctctttccaaaaaaaaaaaaaaaaaaaaaaaaaaaaaaaaaaaaaaaaaaaw

SEQ ID NO: 16348 - DNA, 499 bp, Homo sapiens
aggggatataaaaataatgcattktatgccggaarggataaatctggggctgagtacaagcaaaacaagaccaaaggaagctacctgagcaggtattccagatactcatgtcatacaccaaggttgtaccartgcccctttctctgtgacacatccatccactggraactttcgtacaactagctgaaagaagagraacatcctatttcatgtcactggagccctaatgatcgcagccatttcaggaaatgccatcaattacartgaggagctcattcakaagtgaaagatgagttccattctctgttacttagagctttaccagtacctggcagttctagactacccttcttgaagatctgcccttcttkaagacttaccctatggakttagaaattgctagccagctcctataatcaagttaattaactgatctatatatttaaccaataactattgagcacctactgtgtcatccctacaataatactggacccag

SEQ ID NO: 16349 - DNA, 306 bp, Homo sapiens
gagtatgttctagaacttgcttctgtgtttgtgtcttcaaaacagctgctatcaccaataattaaaccataaaaaacyaaaattatttttccctctggggtgattacaaccacacgggagctgtgattagagatgaaagaactgaccctcaaggagaccaagggataatgaccatgatgatcacatgatagcccagtcaaactggccacttggttctcaaaccctggccttttaagtcaaaattgtattactacactaaaacctctttccaaaaaaaaaaaaaaaaaaaaaaaaaaaaaaaaaaaa

SEQ ID NO: 16350 - DNA, 447 bp, Homo sapiens
aaaarrcarctgctatcaccaataattaaaccataaaaaaccgaaattatttttccctctggggtgattacaaccacacggaaggtttkatgagagaggacaccattcatgtcagattaaragccgctcttctccagtatgatctcatcttaatttagataatgacgtccacaacaatccattgccaagtaaagtcacattctcaggtgctgaagatataccaatgaataaaatagacacaaaagcaacaacaacaaaatacctgctctcaggagctgcttacataccagcagagatgggcaaataaagggcatggctgagaactgcaatgagtgcctttggaaggcccaggggaaccacggtggacgtcacggccaaaagattactgccgaggactgcatctcaaggaatgggcaaggggaagacagaatcaggctaactcagcaa

SEQ ID NO: 16351 - DNA, 304 bp, Homo sapiens
acacatccggtagagttagagcccgtgcggaggcggtgcggasattttcggctctgagcggctgggcgaccggcgcgtcgtgcggggctgcggcggactcccttwaagggaaggtgcaagaggttggcagcttcgattgaagcacatcgaccggcgacagcagccaggagtcatgagcgacasscccgagcagaactacggcgagcgggttaatgttgaagaagggaaatttcggaagtcgtcatttgacaagttttataaatgagtatttggaagctcagggaataagtgaagctgaaatttg

SEQ ID NO: 16352 - DNA, 416 bp, Homo sapiens
acacatccggtagagttagagcccgtgcggaggcggtgcggasattttcggctctgagcggctgggcgaccggcgcgtcgtgcggggctgcggcggactccttaaggaaggtgcaagaggttggcagcttcgattgaagcacatcgaccggcgacasagccaggagtcatgagcgacassccgagcagaactacggcgagcgggttaatgttgaagaaggaaaatgcggaagtcgtcatttgacaagttttataaatgagtatttgaagctcaggaataagtgaagctgaaatttgaaaaaawaaaagaaagaatgcatgctaattatcagaccagaagtcccacttgtagaatattgagcaatttgtgtgaagtggggaagatgaaagaagtcagaatttgaaacggaagaataa

SEQ ID NO: 16353 - DNA, 289 bp, Homo sapiens
agagttagagcccgtgcggaggcggtgcggasattttcggctctgagcggctgggcgaccggcgcgtcgtgcggggctgcggcggactccttaaggaaggtgcaagaggttggcagcttcgattgaagcacatcgaccggcgacagagccaggagtcatgagcgacastccgagcagaactacggcgagcgggttaatgttgaagaaggaaaatgcggaagtcgtcatttgacaagttttataaatgaktatttgaagctcaggaataakgtgaagccaaaaaaaaaaa

SEQ ID NO: 16354 - DNA, 447 bp, Homo sapiens
agtgtagccgggtcagctggacagggtcatcctgagggtgcgactccgccgcgatggtgacccggttcctgggcccacgctaccgggagctggtcaagaactgggtcccgacggcctacacatggggcgctgtgggcgcgtggggctggtgtgggccaccgattggcggctgatcctggactgggtaccttacatcaatggcaagtttaagaaggataattaattacacaaacccttcacagactgctctggtgcctggtggygctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggt

SEQ ID NO: 16355 - DNA, 436 bp, Homo sapiens
agtgtagccgggtcagctggacagggtcatcctgagggtgcgactccgccgcgatggtgacccggttcctgggcccacgctaccgggagctggtcaagaactgggtcccgacggcctacacatggggcgctgtgggcgcgtggggctggtgtgggccaccgattggcggctgatcctggactgggtaccttacatcaatggcaagtttaagaaggataattaattacacaaacccttcacagactgctctggtgcctggtggygctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctrcaaaaaaaaaaaaaaaaa

SEQ ID NO: 16356 - DNA, 534 bp, Homo sapiens
aagggataaatctggggctgagtacaagcaaaacaagaccaaaggaagctacctgagcaggtattccagatactcatgtcatacaccaaggttgtaccagtgcccctttctctgtgacacatccatccactggaaactttcgtacaactagctgaaagaagagaaacatcctatttcatgtcactggagccctaatgatcgcagccatttcaggaaatgccatcaattacagtgaggagctcattcagaagtgaaagatgagttccattctctgttacttagagggtggatatcctcctccactgaatgcaaactattaagtaatgaaaagacagcactccaagcaatatagatttataggccaacctggcaatcaagggtaactgacatgaaaatggattgcttcacattttaattacaaagatactcttcagtaccataaattgaagaaaacactaactttttgtggctactgtaattgtcaaagtataattacctgtgttttctcacctacgtatttgagatagacaaaac

SEQ ID NO: 16357 - DNA, 474 bp, Homo sapiens
tagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcstggctccgctgtgtggatggggagatcggggccagaggcagaaccctggtgagtaagctccagtcctgctctctacccagcccatcttgcctccatggtgcctctggaggcctctgggctctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgg

SEQ ID NO: 16358 - DNA, 473 bp, Homo sapiens
gagtgattccaatggaagcaactgcagaggtggtgtggccgtgccgggacttgcagagcttttctgcttattttcaagtgacgcccgtgttggcaccttagctccaggtgcagagctttaaaggattatggagtctgaagaccaaatgggatgatggagaacagctattcagtggtacaaatgtaaatgctcccaggcccgggcagaaaagagaaaacatttccatggaagaggaaacaggaaattccaacagatcagcaacagttggagtgctaacctgtcactggaatggaaaaaaaaatgctgtcgttgacacatcttttccttgtttttgacacaaattaggctgaagtacagtgatgccatctcgactcactgcaacctccgcctyccaggttcaagtgactctyctgcctcagcctyccgagtagctgggactacaggcatgcggsaccatgcccagctaatttttg

SEQ ID NO: 16359 - DNA, 494 bp, Homo sapiens
agcgagtcagggagtgattccaatggaagcaactgcagaggtggtgtggccgtgccgggacttgcagagcttttctgctwattttcaagtgacgcccgtgttggcaccttagctccagagagccacatggagaacccacatataggtgttggagcagacagcctggcagaggtcccagcaggcggccagcaccaacttgccagctgtgtgcgagtgagctgtcttggaactggagcatccagcttcaggtcaagctgccctgattgataccacatggagtcgaggagcctggtgagtggaggagactgaagatggcgagagagcctggacctcaacatgagcatctggagccatttggcagcattaggctgtgaccgcttagagaaccgaaagatggagtctcgctctgtcgccaggctggagtgcagtggcgtgatctcggctcactgcaamctctgcctcccgggttcaagtgattctcctgcctcagcctc

SEQ ID NO: 16360 - DNA, 432 bp, Homo sapiens
aaatgaagggtaacattcatgtcctcattgtctcatcttagtgagacagaagacctaaaatttctctgaaaatcagaaaactctgcataaaacatggaaggcttcattcataatagtaacccagagaggccagccaaagatgtgctacgttatattttatggaagaaaaatcacttatagaaactgatggcgagaaactcaggactttgttaaatattcaagacctacattacagactgtaaaaagaggagcccactgcccaatggagaatgtttttgaagtccacagataatatcgtctacaatttattttctctgctgaaaaaagaaactcatgcaggaaacattttgaaaccaagtaaataaaacagagatgcccgcaatttcctgcaagtctgactaaaaataggaaactctgcaatcatgaaagtcg

SEQ ID NO: 16361 - DNA, 281 bp, Homo sapiens
aaaaagaggcagagcgcgcgcaggtgtgaggggcggcgacatctgtggggttcagagcgtctgtcagtcaccgacgggctccggcttcacgtgggctctcggcctgtggagtcctcacttctcggtggtcggcgtagtgtcagtgtggggcttgtcaccgggagcggggtctacagcgcccaccctcaggcctttccatctttcacctccggactcgaggcctccagcgttctgtgagggccaatttggccatttattttttccaaaaaaaaaaaaaaaaa

SEQ ID NO: 16362 - DNA, 97 bp, Homo sapiens
cttttcagtccttgcgcaccggggaacaaggtcgtgaaaaaaaaggtcttggtgaggtgccgccatttcatctgtcctcattctctgcgccatcgca

SEQ ID NO: 16363 - DNA, 506 bp, Homo sapiens
taaaatgtttgtgggtaaaagctaatggccaaaatggttccaatcattcatactagttaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtt

SEQ ID NO: 16364 - DNA, 457 bp, Homo sapiens
tgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcagg

SEQ ID NO: 16365 - DNA, 438 bp, Homo sapiens
cacctgagtcccgtctccattctaggtatgagaccagcggcatcggggaggcacgggttaaggaggtgctcctggacgaggacgacgacctgtggatagcactgcgccacaagcacatcgcagaggtgtcccagtaagagccccctgcccccttctccagcgaggcgcctctacmcagctgctattgatgatgcgttcactctgggcacctcgcgggggctcatcactgtgtgaattcgttttcttggcagagtcaccaacatgctaacccgtaatgataaawyccttctgttctctgagcttgagctactccgacttcatgaagttagaaaatcaattctgtattagggctgcttttaggattcttggaaaacatatgtagctctctcagaaaaatgcattacaaacattaaaaatttaaagctagttcattctatt

SEQ ID NO: 16366 - DNA, 290 bp, Homo sapiens
  misc_feature 259: n=a, g, c or t
aaccttgggggcctcactgcagccgccgctstgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaasttcgtctcccagattgcagacagaatctcgctctgttgcctgggctggagtgcagtggcactgtatccggaattngggggttcttggtctcactgacttcaagaat

SEQ ID NO: 16367 - DNA, 519 bp, Homo sapiens
cacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattaatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttgg

SEQ ID NO: 16368 - DNA, 391 bp, Homo sapiens
actgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaaaaaaaaaaaaaaag

SEQ ID NO: 16369 - DNA, 452 bp, Homo sapiens
  misc_feature 132: n=a, g, c or t
cagaggagtcccgcgttcggggagtatgtcaaggccgtgacccgtgtattattgtccgagtggccggaacggagccaacatggcagcggggttcgggcgatgctgcagggtgagagggagcccagcgtgcgntggggctggaacatgggtattgtggtgtcggagcagggggccctgggcaaaaataggtgcggccgggaggagtgggaagtcgggctgaggaaggagccagcctaggggcccccaacctgctttcacgcctcctaccaccggacggaacgtagcctagcgtttcattttccgtatcctcccgtcagcgaccccgttatagccggcatcctctctttagaatatcgtttttctttctctggtaaaccctccaaatatttaccgcgggaatcccacctttttccaaagtgaccccgtctctgtgtcagaaccacgggaaaaag

SEQ ID NO: 16370 - DNA, 478 bp, Homo sapiens
aaaaagagggcctgagtgttacctaacaggccaccatagccacagcctatgtctgcaaactccacttgggcctgagctctcttttctttcttatcctttgggtcatcgtggctctgattttgagtgagtggagcragaactctgggtatagctcagaccagtccatctcctctggcttcacagggctattggaaagaagacataagaagcatgagaaggccctgagcctgtgcgattatttcgagagtcaaaatgtggatttccgaggcaagaagktgatcgaactgggtgcggggacaggcatcgtggggatcttggcagcgctgcagggtgcgtgastggctttttacgggagagagtggggacccaggggcgcggagaaatggtcacttcgtggatctttgggggakaggggagaactttgggcccagtctaaccccttctttttaacaaatttttttttaaaaaaaaaaaaaaa

SEQ ID NO: 16371 - DNA, 406 bp, Homo sapiens
acaagaaattctccaagtttccaagaagggaagatggagtggagggcgcccaccctatctccagtggacatcccctgggctactcctctcctgatgagaaaatgctcacttcagccaagtgcagaatggtcccctttgttttcgtgggtatcagtggagaatgagatccttcatatggaatctccctgtgttgctcaggctgatctcgaactcctgagcccaagcatgcatcagcctctcagtagctgtgattacaggcattgagtcaccactcctgagaaataacaggactttggtgctattctccaagctgaaagccatcctcttcggccctgaggacacagctttttctgccataactcactgtctccactggctcaattagccaattagtggcattgtagag

SEQ ID NO: 16372 - DNA, 542 bp, Homo sapiens
cagttgtttcgggacgcgccgagcttcgccgctcttccagcggctccgctgccagagctagcctgagcccggttctggggcgaaaatgcctgcccttcacatcgaagatttgccagagaaaggaaaaaactgaaaatggaagttgagcagcttcgcaaagaagtgaagttgcagagacmaacaagtgtctaaatgttctgaagaaataaagaactatattgaagaaccttctggagaggatcctctagtaaagggaattccagaagacaagaacccctttaaagaaaaaggcagctcgtagttatttcataaataacttggggagaaactgcatcctaagtggaagaactagtttgttttagtttttcccagataaaaccaacatgctttttaaggaaggaagaatgaaattaaaaggagactttcttaagcaccatatagatagggttatgtataaaagcatatgtgctactcatctttgctcactatgcagtcttttttaagragagcagagagtatcagatgtacaattatggaaataa

SEQ ID NO: 16373 - DNA, 515 bp, Homo sapiens
cccggagagggggagccgcggggacgcagcgacagactcggggtgctggcagcggcasccacgcctcccagggattgcaggcctgggcgccggggttggaccagtctcccgggcatggcacgccctggttattctgtacccgtgatttgtggcggggcaagacgttaagttgggtgacaccgaggtgagccacggtccggcaccagatgaggaaccactgtctcaataagacaccagtgatgctgttaaacaaggacaatccggttcatggattgtgacaacgcacgctgacatcaagcagaccctgccgtcagtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgtt

SEQ ID NO: 16374 - DNA, 495 bp, Homo sapiens
aaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaagggga

SEQ ID NO: 16375 - DNA, 436 bp, Homo sapiens
tagggagggtgtcacccactgtgcatgagcacagtgacacacacctgtcctggraagaattcctgcttttttatttatttawtttawtttawtttawtttawtttawttttactagtctcactgaaggtwvwagatttcttttggaatcaaagtagatttcattttcctttgtgatgtcattagaaatttttagcctttgtgtcaatggaaatggagagaaagaaagttcatgatgacatcacaagattctgttgccttgaggactttgggcaaaactaagtaaaatgcataattcccttgtgtgcgtgtgttccccattctgctacgaagcagtcaaaatagcacatcttatgtcttcccgtgagctacaaggctgtctctcagagccccattgttccataaatgcatgtcagagtctaccacagtctggtctam

SEQ ID NO: 16376 - DNA, 491 bp, Homo sapiens
agggttccgtctgctcatcagacaacagatatttattgaatgttctttgtcatgcgtcttcaagatgtgccatggccattcatgcaagtttcaaggactctgaatctgttgagaaaaagaggttacgttccaattctgctttaattccaacccaaatgctgagaaacactccatggaatttaattacagggcgataactgtgatcttaccaagatttatgaacaggaagatccttggtgattgtagtcagtcaaagggtggctttgacatagcacctatctgttagggcaaatactgccagggaaaaggtgacatttggaatcatctgggattggactcttgatcaatagatgcgaaatgtcaggtggacatgagaactgttggtctttggtacatatgtgttgcaatgagtaaggatgagtaatgtgaaggaaaagtagaatcttgggaccccaaactcactatgccaaagggaaagttaagcgtgggag

SEQ ID NO: 16377 - DNA, 364 bp, Homo sapiens
  misc_feature 283,307,315,320,325,335,364: n=a, g, c or t
cttttctatgtcaattttctggcaacaaagtctgtggccaagaaagaagctaccgactccttcgaccacaaaaagttcttccaaatggtcggcctgaagaaaaagagtgcggatgatgtgaagaaggtgtttcacatgctggrcaaggacaaaagtggcttcatcgaggaggatgagctgggattcatcctaaaaggcttctccccagatgccagagacctgtctgctaaagaaaccaagatgctgatggctgctggagacaaagatggggacggcaaaattnggggttgacgaattctccactctnggtggctngaaanstaangaaggcactngactggcccctgggtcttccacctctctn

SEQ ID NO: 16378 - DNA, 309 bp, Homo sapiens
attctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacc

SEQ ID NO: 16379 - DNA, 424 bp, Homo sapiens
ttcactttattacaatagtggcaatttagcttttcagtattacaggaatttaaaaattggtttcttgtaggggacatctcaactttgggaatatcttcacttaatttttaaaaaatattttcatgctttattgtccagctatacaatatatcgcaaaatcctgacaagttcattgtattaaggtattaactattacatggaaagcaattctgttcatcttttgatgtttgtgttgaaaatgcttatctttgtgttttgatcttccaacagctgagagcttgaactgatttaaacatttgtcaatatacttaagaatgctttaagtaaagaaggggaaaattttaagtaagttttttcccttctaggaagaaaaactatgatgatgttaagaaaatgtcattatagagcttgctcaataatatgt

SEQ ID NO: 16380 - DNA, 400 bp, Homo sapiens
agtcccagcattcccctgggctgtgacttcgttggtctgaaaatgcttgcacaggttgttcccacagcctggaagtctcttccctgacttgttccacgatcaacctctactcacccttcaaggctcggctcaaatgccccttgccccagaaaccttccacaagtcctgaaggcatcactgaaccccatttccaggatgagcccacagcactgcatacaatgagttgagcagtaattatttgtatctggtccaggttcccaatgattaactccttgagagtaggaacactatcacgttcatcttggaatcctcagtgactgacacagagcttgctgtacaagaagccctcaaaaaatgtgtactgaatgaataaaatgcatgtcctagaaaaaaaaaaaaa

SEQ ID NO: 16381 - DNA, 167 bp, Homo sapiens
ccctgggctgtgacttcgttggtctgaaaatgcttgcacagtattgtgtccagaattggttccttccggtgggttcttggtctcactgacttcaagaatgaagccacggacccttgcggttgttcccacagcctggaagtctcttccctgacttgttccacgatcaa

SEQ ID NO: 16382 - DNA, 82 bp, Homo sapiens
aacatgttagaagggtcagagggagagaagttagtccatcagatgtgagagaagactccaaccttgagtcatctcagttgac

SEQ ID NO: 16383 - DNA, 497 bp, Homo sapiens
caagaatgaggaatagggagatgaaaacctgtgttaacagtgacaatgaggccgggcacgtggctcatgactgtgatcccagcacttcaggaggccgaggtggacagatgacttgaggtcaggagttggagaccgcttgggcaacatggtgaagccttgtctctacaaaaaaatgcaaaaattagctgggggtggtggtacatacctctgggcccagctactcaggaagctgaggtgagaggattgcttgggccggggaggcacaggctgcagtgagccgggattgtgccactacgctccagcctgggcagcagagccagacactgtctcaaaaaaaagtgacaatgggacatcggaatggatgtgctttagcaggcaggtaaaaatgtgggactgagctcagttgtgaagtctaagcaacatgtttatatttgggcatcacttgaatgggagtgactgctgataccctgatagtgaatgaagtctaaggaaagcaa

SEQ ID NO: 16384 - DNA, 472 bp, Homo sapiens
  misc_feature 116: n=a, g, c or t
gtagacatgaacattcagaccatagcagtatcttattaagtttttctttacaatttagtaactcagttgttgtaatcagataatttgttacttcttagatcacagtgtaatttctntgaagataacttactctttttggacttctttgaaccttggaagactatagaccctttggccatgttatggtcttttaaaatgtatttttgatttttctaatgaggctgatctttattttgaccatctttttttttctttctttcttttgattgattgattgattgattgagacagggtctcactctgtcacccaggctggagtgtggtggcagagtcatggcccagtgcagcctcgacctcttgggctcaggtgatccttctgcctcagcctcctgagtagctgggaccacagatgtgcaccaccatgcctaattttcttaaattattattggtggatatggggtcttgctatgtt

SEQ ID NO: 16385 - DNA, 346 bp, Homo sapiens
agcactttgggaggccgaggcgggcggatcacgacatcaggagattgagaccatcctagctaacacgatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataaaaaaaaaaaaaaaaa

SEQ ID NO: 16386 - DNA, 490 bp, Homo sapiens
ttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattggtgtattttgtttggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagt

SEQ ID NO: 16387 - DNA, 391 bp, Homo sapiens
aacattgggttttactaataggggtatgtgttgagaaaatttcaaagttttagaatatggttcacccacatgttgcttccctgtaaatataatttttaaaaccagattctgggccgggcatggtggctcacctctataatcccaaaacgttgggaggccgaggcaggcgaatcatgaagccaggagtttgagaccaggctgaccaacacggtgaaacccagtctctactaaaaatacaaaaaaaattagctgggcgtggtggcaggtgcctgtaatcccagstamtcargaagctgaagscaggagaattgcttgaacccaggarggcagaggttgcagtgagccaagatcgcaccattgcactccagcccgcgcgacagtgtgagactcc

SEQ ID NO: 16388 - DNA, 490 bp, Homo sapiens
aaaatgaggtttgttaagaatattgttttgaaggaaaacacttctccttatttaattctgaccttgaaacttctgataatggaaacaaaagagggtttacaaattctttaaaattataagtatagtagaatcccaagcacttaagaaatctcctaacaagttttctctccttttcattctttgttagattatctacgaataaatttagtaattggtgaatacatattccctgtactaatgatagaactgataaaagcatttccaaattaatttttatttagaatatttaatgattttctttcattttatcctttttatttcattaaaaaatctaataacacataccattatttcatattttattaagtgtttacacttttctaacatttatattcttcatgaatagaaccaactatcaacatgatttggactaaagttcattagtcttattatatgtaagaactccttacctcttggaaattacaataga

SEQ ID NO: 16389 - DNA, 161 bp, Homo sapiens
cacaggacattctttcaccagagtttcatgaacatttcaataaattgatggccagacctgcagttgctctacactttcaggtaaacttaaattgaaggtttttttttttttttttttttawaaggcaaataartatctcactattttakccttcaaatatt

SEQ ID NO: 16390 - DNA, 440 bp, Homo sapiens
actcagtcctggtggggtcgcacgtaacggtcctgagctatgcatahgccgtttgaccacgcatggagaattttaccacccagagacacgcgatgccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaasacctgttgatgcttttgactttctgtccttgttcctcgtcccatctggagcatttccaattctggttttgcggasagcaggtctgagcttgtccgkcgagggtgggagttggtcccggcggagatccagtgggaagagccggcggctgcccgggcgtctccttgagcctccagaggactcacaacactcc

SEQ ID NO: 16391 - DNA, 456 bp, Homo sapiens
tatcctcagaaaggactaacagcactctcagcagagggagactgagtccttcattcctgggaggtgtctgggaagcacatcgcagtgtsaccgcagcagcaacacaaaatggactaagacacccagcaagccccaggagcatcaaggaagcaggcatgaggtacctgctgggcccaccgtgctcactgctttctcactgcgtctggaggtcctgagttcasaacaatgagaagttttgagctggataaaactgttcatttatggagcatattggaaaaggagggatcacacatgtctcagaaacaatgggatgcatttcctgtttggtagagggaggcttctaaaaggttgattggttacaaaattgcctctctaaaagactcctttctaaaggcaaataaggaaactgaaaagcttaagagatgaattaaagacgaaaataaaatrattatatgg

SEQ ID NO: 16392 - DNA, 407 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctcaaaaaaa

SEQ ID NO: 16393 - DNA, 406 bp, Homo sapiens
gagaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgacaaaaaaaaaaaaaaaaagc

SEQ ID NO: 16394 - DNA, 376 bp, Homo sapiens
agtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataaccaaaaa

SEQ ID NO: 16395 - DNA, 449 bp, Homo sapiens
agtgagatttcaagggccgggtctggggccccgcgggcgcgcagtgctgcggcgtgtggggagtacggggaggctggagaggagccggccccgggcagtgtgaggtgcggaagcgcggtccagacactttgctgacgggaggccggtccgccagatccgggaggtggggcctcgttctggactgctgaagaaatttgggtacagagacagacaagcaccaagagaagatgatgtgaagaagcacagcgagaacaccatgtgaaaatggaggactggaatgaagcatctacaagccaggaaatgtctgaggctaccagaagccaggagagaggcctggaacagatcctgcactagaaccttcaaagagagcatggtcctgctgacatgttgattttggacttctggcctccagagctgtgagaataaatttcagttgttttaacccaaaa

SEQ ID NO: 16396 - DNA, 611 bp, Homo sapiens
tttttccgctccacggtgacctccgtgcggccgggtgcgggcggagtcttcctcgatcccgtggtgctccgcggcgsgccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggagtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgcatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttag

SEQ ID NO: 16397 - DNA, 472 bp, Homo sapiens
acgcggtctgtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgtgagtctccaagaatgggccaggcctctgctctgctggttggggttggggttggggagggagtgttgactgkagcgggcatcagtatggctgggggtggcaaagtgagctgtcagcttgaaattcaaggcactggtaagcaggctacttggattaaggacaggaatcttaggaacaaaacaaactttgaaagaactcattcatcccattt

SEQ ID NO: 16398 - DNA, 419 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgcctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctcaaaaaaataaataaataa

SEQ ID NO: 16399 - DNA, 508 bp, Homo sapiens
acagtcacacgcggcgccccattaaagcggccgtcccgggcgcgcgcctcattcgaggcacgggctccgggccctgatagatggggtgcggggacggagacaaatgacggcctttgggctcggaatacccacctttctggtaatgcagcccagcggtcccagcctcgttttccagccctcactcaaaatggagtcgctctggttcgaacgcctctgacaacccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagc

SEQ ID NO: 16400 - DNA, 433 bp, Homo sapiens
atatatggggagatttgctctgctacaagggtttgtgataaaggattaattttcttaattactatactttgcaagaatcgatattattatctttaaagcaaaattaggaatgcctttgttcttcagatatggcgatatctggacactcctaagtccgggtctgttttagtaaacattattaatttgttcccttaaccataaacctctaggggctcggaatacccacctttctggtaatgcagcccagcgggtcccagcctcgttttccagscctcactcaaaatggagtcgctctggttcgaacgcctctgacaagtgtgtacctacgtgtcaggatttgccgggtgctgggccccagaagccagccctcctgacgtgtggcggccgtcctcaccgctccctccttccctgcagcatttccccagcccccggc

SEQ ID NO: 16401 - DNA, 848 bp, Homo sapiens
  misc_feature 710: n=a, g, c or t
aatcaaagaagaggaaagcaaggtattttttcacctcagattctaatatattctagatttgtttctgttttatagatttaattcaatacctccacatagatgtttttatattacatgaatttaataataaactaaatttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggntggccatgttctctgaattgggtgcagaagacaagggcagagtggctgcggcccctattacctttgtagcagccacatcagaaagcagaagaaaacagtatttctgaaggcattgtttgaggttgatctcagcactga

SEQ ID NO: 16402 - DNA, 257 bp, Homo sapiens
ctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttata

SEQ ID NO: 16403 - DNA, 421 bp, Homo sapiens
aagatttttattcagttgaatatgtagacaaccaccagctaatctctattggcttggattttgtggtttagaaaatactcatcacctgcattgtcctaatgatttatgatgagtgggatcataatttgtgagtgctggtgtcctctgcaggaacacaggcttaacatcttgttcaagggtaccagttggtaagctccagaatttaaacctaggacatggattctactgccttactctgctcttcacgtcacactggagcagaataacttgactcaggatggttggagaaagagaggtggaagaaggctgagaaaaatagtgaagatggaagactttgttttgggatctttcagaatctctactctcaagtggtccattttcttggactactatccagagataagatgagaataaagagaca

SEQ ID NO: 16404 - DNA, 496 bp, Homo sapiens
ttgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatataatggtatattataaaataaagactttcttaaaggaaaattgcacctatttta

SEQ ID NO: 16405 - DNA, 432 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctcaaaaaaataaataaataaaaaaaaaaaaaaaa

SEQ ID NO: 16406 - DNA, 447 bp, Homo sapiens
ctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagag

SEQ ID NO: 16407 - DNA, 180 bp, Homo sapiens
gtaaggsgtggtgggatttgctcctgggttccctaggycctagtgagggsagaagaggaaccatcctctcccttcttacaccgtgagsmaagatsccctcagaaggcaggagtgctgscctstcccatggtgmccgtgcstctgtgctgtgtatgtgaaccacccatgtgagggaataaa

SEQ ID NO: 16408 - DNA, 204 bp, Homo sapiens
gtaaggcgtggtgggatttgctcctgggttccctaggccctagtgagggcagaagaggaaccatcctctcccttcttacaccgtgaggccaagatcccctcagaaggcaggagtgctgccctctcccatggtgsccgtgcctctgtgctgtgtatgtgaaccacccatgtgagggaataaacctggcactaggaraaaaaaaaa

SEQ ID NO: 16409 - DNA, 222 bp, Homo sapiens
gtaaggcgtggtgggatttgctcctgggttccctaggccctagtgagggcagaagaggaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggaaaaaaaaaaaaaaaaaaaaaaaaaaaaa

SEQ ID NO: 16410 - DNA, 569 bp, Homo sapiens
ctggccgccgcccgctctcccggcgcggcactgtctgggctgctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattwtcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatcagataaaaactt

SEQ ID NO: 16411 - DNA, 526 bp, Homo sapiens
ctgggccgccgcccgctctcccggcgcggcagctgttctgggctgctgcgcgccgccttaggtgtctggggcgatctatcgggcaagagcaagggccacgatcgacagattacggcgaggagcagcgcaacgasctcggaggccctgggagtccatctaccctgatvtccttcacagtatttattcaagaaaatccacccaggctttcaccaattaactgtgacgtctgaggctggagaaaatgatgaaactgttccagaacttaccctcaagtttacatacagtgaaaaatacccagatgaagctccccctttatgaaatatttctcccagggaaaaatctaggaagataatgatgtctcagacattttaaaatttactagcattacaggcctgaagaaaatcttgtggtatgggtgatgatttttacctctagtgacagctgtgcaagaaaaatttaaatgaaatagttagatcagataaaaaactagaagagaagaagaaaagaaacaaaaaaaaaaaaaaaa

SEQ ID NO: 16412 - DNA, 372 bp, Homo sapiens
ctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaa

SEQ ID NO: 16413 - DNA, 457 bp, Homo sapiens
atttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttgggtctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaa

SEQ ID NO: 16414 - DNA, 423 bp, Homo sapiens
  misc_feature 150,152: n=a, g, c or t
atttgtttagttttgttttagtttttatttttatttttaaaataaatgttatcagatatrtcsctgatactaaagtgaacgtcatttactagttgctgaaattcacttgttagaaaataggctgggcgtggtggctcacgcctttaatcncngcgctttgagaggccaaggcgggcggatcacctgaggtcaggagttggagaccggcttggccaacatggtggaacccsgtckctgctggaaatacaaaaattagctgggcatgatggcatgtgcctgtgatcccagctacttgggaggctgaggcgggagaatcgctggagcccgggaggcggaggttgcagtgagccaggactgcaccattgctctccagcctgggcaacaagagcrraactctggtctcaaaaaaataaataaataaaa

SEQ ID NO: 16415 - DNA, 402 bp, Homo sapiens
  misc_feature 20,31,139: n=a, g, c or t
ctggccgccgcccgctctyncggcgcggcwntgtctgggctrctgcgcgccgcctaggtgtctgggcgatctatgggcaagagcaagggccacgatgacagattacggcgaggagcagcgcaacgagctggaggccctngagtccatctaccctgactccttcacagtattatcagaaaatccacccagcttcaccattactgtgacgtctgaggctggagaaaatgatgaaactgtccagactaccctcaagtttacatacaaaacaaatacccagatgaagctcccctttatgaaatattctcccaggaaaatctagaagataatgatgtctcagacattttaaaattactagcattacaggctgaagaaaatcttggtatggtgatgattttttacttt

SEQ ID NO: 16416 - DNA, 442 bp, Homo sapiens
  misc_feature 18..19: n=a, g, c or t
ctggccgscgscgctctnncggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagtgacagctgtgcaagaaaaattaaatgaaatagtagatca

SEQ ID NO: 16417 - DNA, 442 bp, Homo sapiens
ctggccgccgcccgctctcccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagragataatgrwgtctcagamattttaaaattacyagsattacaggctgaagaaaatcttggtatggtgatgatttttactctagtgamagctgtgcaagaaaaattaaatgaaatagtagatcm

SEQ ID NO: 16418 - DNA, 395 bp, Homo sapiens
  misc_feature 20: n=a, g, c or t
ctggccgccgcccgctctcncggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctaggaagataatgatgtctcagacattttaaaattactagcatttacaggctgaagaaaatcttggtatggtgatgatt

SEQ ID NO: 16419 - DNA, 400 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaacccgtctctgctggaaatacaaaaattagctgggcatgatggcatgtgcctgtgatcccagctacttgggaggctgaggcgggagaatcgctggagcccgggaggcgaggttgcagtgagccaggactgcaccattgctctccagcctgggcaacaagagcaaaactctgtctca

SEQ ID NO: 16420 - DNA, 403 bp, Homo sapiens
ctggccgccgcccgctctcccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctgaagaaaatcttggtatggtgatgatttttactctagt

SEQ ID NO: 16421 - DNA, 371 bp, Homo sapiens
ctggccgccgccgctctchcggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacaaaaaaatacccagatgaagctcccctttatgaaatattctcccaggaaaatctagaagataatgatgtctcagacattttaaaattactagcattacaggctggggaa

SEQ ID NO: 16422 - DNA, 392 bp, Homo sapiens
cagtttagtaaaagccttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttttaaaaaa

SEQ ID NO: 16423 - DNA, 464 bp, Homo sapiens
tataatagtctttatcaaaacagggtggtatcatggacataaagatggaaacaatagagactgagcaccagggactatgagagtgggagarggttgaagaactaccagtcggggactgtgctcaccacctggctgatgggatcatttgtacaccgtacctcagtgacttaaatcaagaattacccatgtaacaaatctgcacgtgtacccctgaacctaaaataataaagttgaaagaaaaaacagggtggtggcattattattaaagtaaagccaaagagttctcattagaattttgtatcttagtatgccattttctagaggtcactgggattggcttattttactttgtgctacttttgtcaaataagtaaaatggataggtttaaaaaacataaatactcatagtttattttctaagtaatctaatcttccatattatatggcacttattttatagcata

SEQ ID NO: 16424 - DNA, 413 bp, Homo sapiens
atttgtttagttttgttttagtttttatttttatttttaaaataaatgttatcagatatatccctgatactaaagtgaacgtcatttactagttgctgaaattcacttgttagaaaataggctgggcgtggtggctcacgctttaatctcagcgctttgagaggccaaggcgggcggatcacctgaggtcaggagttggagaccggcttggccaacatggtggaaccccgtctctgctggaaatacaaaaattagctgggcatgatggcatgtgcctgtgatcccagctacttgggaggctgaggcgggagaatcgctggagcccgggaggcggtaggttgcagtgagccaggactgcaccattgctctccagcctgggcaacaagagcaaaactctgtctcaaaaaaataaa

SEQ ID NO: 16425 - DNA, 193 bp, Homo sapiens
cctcccaccccgcgtggactcgctgcgggactgccctcttctcgccccaaccactggtcctccgctctgtccccaggggccctcaccagcttcccgcccggacacgccaggtgtcmagatcccttcccccagctcgccgacccagggcggtggcccgtgactcaggcccctcgtgggactttgggaggaagcg

SEQ ID NO: 16426 - DNA, 317 bp, Homo sapiens
cctcccaccccgcgtgggactcgctgcgggactgccctcttctcgccccaaccactggtcctccgctctgtccccaggggccctcaccagcttcccgcccggacacgccaggtgtcagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaaaaaaaaaaaaaaaaaaaaaaaa

SEQ ID NO: 16427 - DNA, 504 bp, Homo sapiens
caaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggcacagtagtgtctgtgttaagttcactaaatgtgtatttaatgagaaacattcctatgtaaaaatgtgtgtatgtgaacgtatgcatacatttttattgtgcacctgtacattgtgaagaagtagttkggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaa

SEQ ID NO: 16428 - DNA, 317 bp, Homo sapiens
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggcccgtgactcaggcccctcgtgggactttgggaggaagcggcagctgctccgagcggggcccgcccttcccatctcctgccgctcctccctacgcttttgccttctcatctgggtctgtaggtccaaaaaaaaaaaaaaaaaaaaaaaaaaaaaaaaaaaaaa

SEQ ID NO: 16429 - DNA, 295 bp, Homo sapiens
cctcccaccccgcgtggaactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaa

SEQ ID NO: 16430 - DNA, 319 bp, Homo sapiens
  misc_feature 292..294: n=a, g, c or t
acytcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaannnaaaaaaaaaaaaaaaaaaaaaaaar

SEQ ID NO: 16431 - DNA, 294 bp, Homo sapiens
cctcccaccccgcgtggactcgctgcgggactgccctcttctcgccccaaccactggtcctccgctctgtccccaggggccctcaccagcttcccgcccggacacgccaggtgtcagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaa

SEQ ID NO: 16432 - DNA, 293 bp, Homo sapiens
  misc_feature 200: n=a, g, c or t
cctcccaccccgcgtgggactcgctgcgggactgccctcttctcgccccaaccactggtcctccgctctgtccccaggggccctcaccagcttcccgcccggacacgccaggtgtcagatcccttcccccagctcgccgacccagggcggtggccgtgactcaggcccctcgtgggactttgggaggaagcggcastgcntccgagcggggcccgcccttcccatctcctgccgctcctccctacgcttttgccttctcatctgggtctgtaggtccaaaaaaaaaaaaaaaa

SEQ ID NO: 16433 - DNA, 292 bp, Homo sapiens
  misc_feature 177,219,221: n=a, g, c or t
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtggnactttgggaggaagcggcastgctccgagcggggsccgsccnanccmatcttcckgcggktcytccctamgcttttgccttctcatctgggtctgtaggtccaaaaaaaaaaaar

SEQ ID NO: 16434 - DNA, 334 bp, Homo sapiens
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggcccgtgamtcaaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaaaaaaaaaaaaaaaaaaaaaaaaaaaaaaaaaaaaaa

SEQ ID NO: 16435 - DNA, 298 bp, Homo sapiens
cctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggccgtgactcaggcccctcgtgggactttgggaggaagcggcastgctccgagcggggcccgcccttcccatctcctgccgctcctccctacgcttttgccttctcatctgggtctgtaggtccaaaaaaaaaaaaaaaaaaaam

SEQ ID NO: 16436 - DNA, 139 bp, Homo sapiens
aattgtgacccggtttaggaacatgctgcttgcccaaaattctccacaatcctccacctccgctcttccatttaggatataaaagagggttttctcagaccttctgccaatgcgcagacagatgaaagacgacacagag

SEQ ID NO: 16437 - DNA, 379 bp, Homo sapiens
ggaagaagaccatttaatttttaaattttttttccatttcaaggactgtattaagtaacttaaaatggcatattttaaagaggctagctgtatattttggaataatagagtgatatgacttttattaaatttttttcatcagcccttttagtttgatgaaataataccaataatgtcctccctctccactgaaataccagtgttatggattatatgtctaaatttatctttatacttttttttttyctttgacagtatctcactcactctatcgcccaggctgaggttgcaktgasccaagatcacaccaccgcattctagcctgggcaacagagcargactccatctcaaaaaaaaaaaaaaaaaaagagattaaata

SEQ ID NO: 16438 - DNA, 384 bp, Homo sapiens
  misc_feature 371: n=a, g, c or t
ggaagaagaccatttaatttttaaattttttttccatttcaaggactgtattaagtaacttaaaatggcatattttaaagaggctagctgtatattttggaataatagagtgatatgacttttattaaatttttttcatcagcccttttagtttgatgaaataataccaataatgtcctccctctccactgaaataccagtgttatggattatatgtctaaatttatctttatacttttttttttcctttgacagtatctcactcactctatcgcccaggctgaggttsmattgaccmaagwtcacaccacsgcattctagcstgggcaacagagcaggmstccatctcaaaaaaaaaaaaaaaaaagggnatwaattcccggg

SEQ ID NO: 16439 - DNA, 505 bp, Homo sapiens
  misc_feature 449: n=a, g, c or t
attggttttaggtgggtcatcatttgtcagaggccacaatacttaaccacttagtttctctgtagctccttgtgttcaaataatcatttataagcacacagtcagtgtacagccatccctctgtagccatgggggattggttctaggaaccccacccccacagataccaatagccacccaagtcccgtatataaaatcgcatggtatttacatgtaacctgtgcaccttctcccatatactttaaatcatctgtagattacttataataccaaatacaatgtaaatgctgtgtaaatagtatactgtattgtttagggaataatggcaagaaaaaaaggtctgttcatgttcaatacagatgcaactatctttttttttttyctgagtatttttgatccatggttsgttgaatctatgaatacagawtgctgactgtgttagmaaaggntgcctattgaaaatctwtaaaaatggccaggcacagtggctcacacctgtaatccc

SEQ ID NO: 16440 - DNA, 424 bp, Homo sapiens
aggaggcgggtgggtcaaggtaactctgggctacagagtccttgctgggggttcggggagcgcttggaccccggcttctgggacgcgtcagttggatcgatcaacccgggaggtggagctgggcttggaatacggatccccgactatgaacctgggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtag

SEQ ID NO: 16441 - DNA, 474 bp, Homo sapiens
  misc_feature 465: n=a, g, c or t
gtggcgggcaggcggcaggaggcgggtgtgtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggaggaggttcagcgccttcgcaggcggaaccagcagttggaggaagagaacaatctcttgcggctgaaagtggacatcttattagacatgctttcagagtccactgccgnatcccactt

SEQ ID NO: 16442 - DNA, 278 bp, Homo sapiens
  misc_feature 114: n=a, g, c or t
aggagcgcggascggagctggacgccgccgccgccaccgccacctgcgcggcagtcatcaagatgtcatggcacccccagtaccggagctccaagttccgtcatgtctttggcnaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggac

SEQ ID NO: 16443 - DNA, 489 bp, Homo sapiens
ataggcatttcaggctgggattcagggaggttatgtttgctgtcacagacctcaaaccaaaagagtacatcaaaataagtcactggatttatacatttggcaaattctcaagagaccacatgacagaaggagcaataatctgaacattgcttttagctgtaattctccaatgaagtagatttggggaagcaacatgaggtacttgctttatttttttaaatccattttttttctttgaaaaaccacaagattggacttgacaatctttaaggttatacccagctctaagatatttttgtaattatatggaacaaagatggacatgaaatataccaaacgagagtttctaaatttagattctgacagttcaagtcagaaaacatattaagtgttcaggaaaaacaaatcacaatcttccatcacaaaattcaacaagaacaacaaaaaccactccagaggcagctgtggtattctggaaggaatgctggt

SEQ ID NO: 16444 - DNA, 492 bp, Homo sapiens
  misc_feature 467: n=a, g, c or t
agaatgggatgtgcctaagtttatataaatgacagttaaaaagataactgtcacaatgtttactgatgaggtttccatttctcttaacgtttagaagttaaatgaaaaatggattgtggattatagcctgagcagatttgagcctaaatgtaatataacagcttgtggcaaatggaggtagcaggagagtagagccaactagccaaaaatcccctggaaaggtgaaactgaaatcactcattcattcaaaaagtgtttactgagtagcttcaaagagcaaatattaggttagatgcagtgggtgatgtaaggatgattcagacaactatttctcatggactttgcttactgagccatcmacacacggccacctttttctagatgaagtatcccatcatttgattctggattgagaactctttgagagcagagacgatggsttcacctgaktatccccagagctgacngttagacaaaaatcaactttcactg

SEQ ID NO: 16445 - DNA, 388 bp, Homo sapiens
aggtttctgtttggttgccgccctaacggccagaactaaagcaccttgcaaggaatgaagttggttcttgaagtccgtgctgactggctgggcgcatttgcgatttgcttctctggctgcaaaatggcccgcaacagcactcactaatttgttgctaacttcaggaactgtgcggacaggtctctgaggcttctgagccgcgctatgtccagtagatctgggcgcctcagaacctgtcacagccgacggaagcgtttatctgagtttcttgtttcttcccaaccttttgattttcgcaccattacgcgctcaactatgcctcttcttttgtcctatggtctcaactaattaaaggaagaaaagcaatgctaaaaaaaaaaaaaaaaag

SEQ ID NO: 16446 - DNA, 485 bp, Homo sapiens
caacttgttactagacagccagcgcactaataatggcagttaatatgcgcgcctcggatgggggcgattcgtaaaggttagcttgtctttgaatctttggggtgatcggatgtctgcagggcctaagctttgtgggccttctgtgctttactcttgggtgagttatgaatgaaaagaaggggactccatggaatgattgcatagcagcccgcagcgtagacagcctgttccgtggtgtccttttccttccttgggtgcagactcaaagccctgccttcataggacagggagagctgtgcagcttgactccgtagaggtgtgcccttacaaagctggaggaggtacccaggcccatgcgattaatcagcagcattgccttaccgggctcttatccccatccgaaaacttctgtagggtaaatagaagaggaaactccttcattgagccctttgactatctatgttaatgcttttggacttaaaaaa

SEQ ID NO: 16447 - DNA, 363 bp, Homo sapiens
  misc_feature 284: n=a, g, c or t
ctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggacagcaagggggagctggcacccgagctaggggaggagccccagccccgcgacgaggaggaagcggactgnagctgctgaggcagtttgacctggcctggcagtacgggccctgcaccgggatcacacggctgcagcgctggtgtcgggc

SEQ ID NO: 16448 - DNA, 489 bp, Homo sapiens
ttttttttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagac

SEQ ID NO: 16449 - DNA, 486 bp, Homo sapiens
  misc_feature 220,409: n=a, g, c or t
mwcwkkyrgsysmkcykkksaacaggtaggtcatccttgckgccttgcggcatgggcagtatccgccgccatcctcttccgtgagcgcgctgagacccggaccggccctcctgagaggatgccggacccgtcgccatgggccgtgtgatccgtggacagaggaagggcgccgggtctgtgttccgcgcgcacgtgaagcaccgtaaaggcgctgcgcctncgcccgttggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaanaaggcccagctcaacattggcaatgtgctccctgtggcaccatgcctgagggtacaacaccatgcctgagggtacaa

SEQ ID NO: 16450 - DNA, 274 bp, Homo sapiens
  misc_feature 123,127: n=a, g, c or t
gtttcctctttcggccgcgctggtgaacaggacccgtcgcyatgggccgtgtgatccgtggacagaggwtagggcgccgggtctgtgttccgcgcgcacgtgaagcaccgtaaaggcgctgcnstwncgcccrttggatttcgctgagcggcacggctacatcaagggcatcgtcaaggacatcatccacgacccgggccgcggcgscccctcgccaaggtggtcttccgggatccgtatcgggtttaagaascggacgggagctggtycattg

SEQ ID NO: 16451 - DNA, 93 bp, Homo sapiens
cagtgtgaaaaacagactcacaaggggcttcttggcctgcagcttcatttgcgagacgccgaggcaggacacagagcacagctgtstggaaag

SEQ ID NO: 16452 - DNA, 355 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagactgtacgctaagggtcatatcttttcttgtattggtttgtgtcttggttggcgtcttaggtgttaatcctacagtggagggctggggaataggaagtaacatgtggcctgcacgccataggagaaaaagcgagcatcagccgtatcggctttaaaaaaaaaaaaaag

SEQ ID NO: 16453 - DNA, 175 bp, Homo sapiens
atacttacctggcaggggagataccatgatcacgaaggtggttttcccagggcgaggcttatccattgcactccggatgtgctgacccctgcgatttccccaaatgtgggaaactcgactgcatcaatttgtggtarttggggamtgcgktcgcgctaaaaaaaaaaaaaaaaaa

SEQ ID NO: 16454 - DNA, 203 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtggggtactgcgttcgcgctttcccctgaagagaaaaaaaaaaaaaaaaaaaaaaaaaaaaaaaaaa

SEQ ID NO: 16455 - DNA, 207 bp, Homo sapiens
atacttacctggcaggggagataccatgatcacgaaggtggttttcccagggcgaggcttatccattgcactccggatgtgctgacccttgcgatttccccaaatgtgggaaactcgactgcataatttgtggtagtgggggactgcgttcgcgctttcccctgastttaaaaaaaaaaaaaaaaaaaaaaaaaaaaaaaaaaaaaa

SEQ ID NO: 16456 - DNA, 231 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgattaaaaaaaaaaaaaaaaaaaaaaaaaaaaaaaaaaaaaaaaaaaaaaaaaaaaaaaaaaaaaaaa

SEQ ID NO: 16457 - DNA, 189 bp, Homo sapiens
atacttacctggcaggggagataccatgatcacgaaggtggttttcccagggcgaggcttatccattgcactccggatgtgctgacccttgcgatttccccaaatgtgggaaactcgactgcataatttgtggtagtgggggactgcgttcgcgctttcccctgactttaaaaaaaaaaaaaaaaaaaa

SEQ ID NO: 16458 - DNA, 204 bp, Homo sapiens
atacttacctggcaggggagataccatgatcacgaaggtggttttcccagggcgaggcttatccattgcactccggatgtgctgacccctgckatttccccaaatgtgggaaactcgactgcataatttgtggtagtgggggactgcggaaaaaaaaaaaaaaaaaaaaaaaaaaaaaaaaaaaaaaaaaaaaaaaaaaaaaaa

SEQ ID NO: 16459 - DNA, 374 bp, Homo sapiens
aagaaatggcaaactagggatcttacctgggccttcccagttgagactacgtcaaaatgggctcccatgagactgcctggctcatgcagatggaaggctaacatctttttagaaacaactcgtgctaccctctcctgttccaaaagcctgtctggtcagaatggtgtgatgagccctcctcttcagctaggaaaatgacggtgttcagaaagttaaaacttcttcgctggaaggatttcatcttaaagttgaaacggaagactctggtagcagtccytgaaatcttgrtgccattgstatttyckgcatkgwatkgwatcttcgttttagtagtgctccaataaaaagacctgctactaaaaaaaaaaaaaaaa

SEQ ID NO: 16460 - DNA, 486 bp, Homo sapiens
agattccacagtctccggaagcagggctggggaagaaatggcaaactagggatcttacctgggccttcccagttgagactacgtcaaaatgggctcccatgagactgcctggctcatgcagatggaaggctaacatctttttagaaacaactcgtgctaccctctcctgttccaaaagcctgtctggtcagaatggtgtgatgagccctcctcttcagctaggaaaatgacggtgttcagaaagttaaaacttcttcgctggaaggatttcatcttaaagttgggagactggaagaaattaaagtgttctaaatggaagagcattcaccacatgtgttctgttttgggttgacatttagcttttgtttttattttagaaacggaagactctggtagcaatccttgaaatcttgatgccattgctattttctgcattgtattgtatcttcgttttagtagtgctccaataaaaagacctgctactag

SEQ ID NO: 16461 - DNA, 521 bp, Homo sapiens
acacccggaaactcgactttggccgtttctccatttctcctcacgcactgtctttccttgggccctcgtcactcctggcaccgggggaagggcttccccgcctctggccgggcgctggggcgcgaccgaagcgaggcggcggcgaggaaccttctggaattcggccgtcgggggcaggcgtcgagtttacaggagaaggcgcggtgtcccgggatgagcggagtcgccctcacttaaggagcgagggaggcctcgggggtccccagccggtgatgagccctcctcttcagctaggaaaatgacggtgttcagaaagttaaaacttcttcgctggaaggatttcatcttaaagttgggagactggaagaaattaaagtgttctaaatgggaagagcatttcaccacatgtgttctgttttgggttgacatttagcttttgtttttatttytagaaacggaagactcttggtagcagtccttgaaatcttgatgccattgctattttcttcattgtattgtat

SEQ ID NO: 16462 - DNA, 495 bp, Homo sapiens
aggagcgcaaaatggcggaaccgcgagccccgtgcactgtgtcgctgccgcggcccccaccgccaccgtctcggagaaagaaccgtttggcaagctgcaactctcctcccgggaccctccggttctctgtccgccaagaaggtccggactgaggagaagaaggcaccgcggagagtgaacggagaakggggcagcggcgggaacagcaggcagctgcagccgccggcagcaccttcgcctcagagctatggcagccccgcgtcttkgagctttgcccctctgtctgctgctgcctcggctaacgccaagtcgcgcagacctaaggagaagcgggagaaggagaggaggaggcacggtctcggtggggcccgagataaaatcaaagacaaaattaaagagagagacaaagaaaaagagagagaaaaaaagaaacataaagtaatgaatgagatcaagaaagagaatggagaagtaaagattttgctgaaaagtggg

SEQ ID NO: 16463 - DNA, 454 bp, Homo sapiens
agtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgctcctctccagggacggaagccttcacttaggaggacaccatggataccagggaccagtctcccagccttttcagcagcctgagaaacctggtcgtgtmcgtcgtcggaagataggc

SEQ ID NO: 16464 - DNA, 473 bp, Homo sapiens
aaagcccagtctagccatttaaagagaacacatggaagtaaaccaagaacccagccaatatccccagaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaac

SEQ ID NO: 16465 - DNA, 441 bp, Homo sapiens
acattccctctcagattccaaccacgatactgaaaaaaccaaagcccagtctagccatttaaagagaacacatggaagtaaaccaagaacccagccaatatccccagttgactgaaactgtggaaagtgaaatcatggataagaagggactactgtgggctgggcgcagtggctcacgcctgtaatcccagcactttgggagaccaaggcgggcggatcacaaggtcaggagtttgagactagcctcactaacacagtgaaaccctgcctctactaaaaatacaaaaattagccgggcttggtggcgcatgctttaatcccagctgctcaggaggctgaggcaggagaatcccttgaacctgggaagcggaggttgcagtgagccgagatcacgccactgcactccagcctgggcaacgtatcaagtctccatctcaaaaa

SEQ ID NO: 16466 - DNA, 489 bp, Homo sapiens
tgcaggaatgcttcagtgtttgaaagggtgaagaaaagaggattcctggctgggcgtggtggctcatgcctgtaatcccagcactttgggaggccaaggcgggtggatcaccaggtcagaagatcgggatcatcctgcctcagcttcccaaagtgctaggattataggcataagccacaacccctggcccaggagcctgcattttgaaacaaacacgccaggctattttgatggcactggttttcggatctgcactttgacagacagacttaaaccttccgtgtgagtattcgagagcaccatcctgctttcctgagatgacagactcctcagggaggcagccagggcttcctgtttctagatggggaaaccaagccaggcagccctctggaggcttgctgtggggtgccccggcaagctagcgamgcccacagccagagggccagccccgggggatggggggggacaaatattaaaaagaatatgcaa

SEQ ID NO: 16467 - DNA, 101 bp, Homo sapiens
ctggatggcccctccttgcaaccaggcagctgagaccagggtcttacctctctgggacctagggggacggggctgacatctacattttttaaaactgaatc

SEQ ID NO: 16468 - DNA, 459 bp, Homo sapiens
  misc_feature 68: n=a, g, c or t
acacccaggagtccagaccccagctcctcctctctcacacccaggagtccagacccaggagtccaggnccccakcccctcctccctcacacccaggagtctaggtcgccccctccttggggccccaccccactgggcctcttctctctggtccttaggccgcaccaggatgtcggacaccgaggagcaggaatatgaggaggagcagccggaagaggaggctgcggaggaggaggaggaagcccccgaagagccggagccggtggcagagcagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttg

SEQ ID NO: 16469 - DNA, 478 bp, Homo sapiens
agcaaggctcagcctcaagattcacagcatctcagacgcagcctaggccgcaccaggatgtcggacaccgaggagcaggaatatgaggaggagsagccggaagaggaggctgcggaggaggaggaggaagcccccgaagagccggagccggtggcagagcagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcgggcgccggtcagagagagccgagcaacagcgcttcagaactgagaaggaacgcgaacgtcaggctaagctggcggaggagaagatgaggaaggaagaggaagaggcca

SEQ ID NO: 16470 - DNA, 392 bp, Homo sapiens
attttctcctggrcaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcggcctcctcggsttycaggctkargcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctasctaagtcagcctttaaagtcca

SEQ ID NO: 16471 - DNA, 529 bp, Homo sapiens
agttccaaaatggcggcaggggtggccgggtggggggttgaggcagaggagttcgaagatgctcctgatgtggagccgctggagcctacacttagcracatcatcgagcagcgcasctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggastgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaactttctcggtggtggtatttgacacggcacccacgggccacaccct

SEQ ID NO: 16472 - DNA, 346 bp, Homo sapiens
cttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaact

SEQ ID NO: 16473 - DNA, 462 bp, Homo sapiens
caggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagccgccatgccctcagcctgcctcactgctgggccagggtcatgcctatataagttggcatggcagggacaatggtgggca

SEQ ID NO: 16474 - DNA, 452 bp, Homo sapiens
accaagggaacggaaaatggcgcctcacggcccgggtagtcttacgaccctggtgccctgggctgccgccctgctcctcgctctgggcgtggaaagggctctggcgctacccgaggtacagaagcaagtttgaggtcgggctgaagcagggtcrctggccagccgtgcgtcgcgctcgccagcggctcccccttctcctmggcgggcctgcggttctgatttcgtccctgacgcttcccgaccctgcccagccagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtcaaactttcatcaggcacataccactgtcatcatagac

SEQ ID NO: 16475 - DNA, 448 bp, Homo sapiens
  misc_feature 42: n=a, g, c or t
acgcgaggwagatggctgcatcccagcagcaagcttcagcgncttcctcagctgctggtgtatcgggtcctagttcggctggcggcccgggtccccagcagcagccgcaaccgccagcacaactggtgggccctgccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctggtaagaagccttctggacacggggtaacaacagccgtgtcccagtctctggggtcttcagaaacagtcagtcagtcaa

SEQ ID NO: 16476 - DNA, 235 bp, Homo sapiens
attttgcgcacattgaggaccgtggtggcgcatttcctcagcgctttcccgccacttcagcggacagatctggccgcagctaaaccaaggtgtatgttggtaacctgggaactggcgctggcaaaaggagagttagaaagggctttcagttattatggtcctttaagaactgtatggattgcgagaaatcctccaggatttgcctttgtggaattcgaagatcctagagatgcag

SEQ ID NO: 16477 - DNA, 162 bp, Homo sapiens
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaaaaagtc

SEQ ID NO: 16478 - DNA, 119 bp, Homo sapiens
gttgcgcagtagtgctagcggcttcgcggtttcggtcctcgcacccggcagccgccactggtgctgagctgctaggaagcccctatcgccgagctcgttggagcttgaacccattgtca

SEQ ID NO: 16479 - DNA, 95 bp, Homo sapiens
gttgcgcrtagtgctagcgcttcsggttcggtcctcgcacccggcagccgccactggtgctgagctgctaggaagcccctatcgccgagctcgtt

SEQ ID NO: 16480 - DNA, 104 bp, Homo sapiens
gttgcgcgtagtgctagcgcttcgcggtttcggtcctcgcacccggcagccgccactggtgctgagctgctaggaagcccctatcgccgagctcgttggagctt

SEQ ID NO: 16481 - DNA, 134 bp, Homo sapiens
  misc_feature 106: n=a, g, c or t
gttgcgcatagtgctagcggcttcgcggttcggtcatcgcacccggcagcsrccactggtgctgagctgctaggaagcccctatcgccgagctcgttggagcttgnaacccattgtcacccctccgactcaccg

SEQ ID NO: 16482 - DNA, 137 bp, Homo sapiens
gttgcgcatagtgctagcgkcttcgggttcggtcctcgcasccggcagcsgccactggtgctgagctgctaggaagyccctatcgscgagctcgttggagcttgaacccattgtcacmcctccgactcaccggccca

SEQ ID NO: 16483 - DNA, 154 bp, Homo sapiens
gttgcgcatagtgctagcstcttcgcggttcggtcctcgcacccggcagccgccactggtgctgagctgctaggaagcccctatcgccgagctcgttggagcttgaacccattstcacccctccgactcaccggcccaaaaaaaaaaaaaaaaa

SEQ ID NO: 16484 - DNA, 441 bp, Homo sapiens
cttttatagcgtcctaaggttggaggcacatttcaatgtttccgaatgcctcctaataacattcaggtagagagcacatcattctgctctgtgttgtgacacaaaattgctcatcatatttcacttctgagaatctttcacccatctgtctcgtgaccaagttataaaacgacagagtaaacttaaaactgcagagagcgggggaatctgttaaactgactattggacagacattgaatgcaacaaacacaagttgaagaaaaaggggtttctccaattttgatccaataattacctgacatttaacagctatattcttagcgttgacctgtgatgttggtcttgagagactcagctgatcttgaacaaatcaactttctctccatgggtgtgatcctcaaccagaacatctaggtcttggacaagatgtctcctgagatt

SEQ ID NO: 16485 - DNA, 108 bp, Homo sapiens
gttgcgcatagtgctagcgcttcgggttcggtcctcgcacccggcagccgccactggtgctgagctgctaggaagcccctatcgccgagctcgttggagcttgaaccc

SEQ ID NO: 16486 - DNA, 154 bp, Homo sapiens
gttgcgcatagtgctagcktcttcgcggttcggtcctcgcacccggcagccgcaactggtgctgagctgctaggaagcccctatcgccgagctcgttggagcttgaacccattgtcacccctccgactcaccggcscaaaaaaaaaaaaaaaaa

SEQ ID NO: 16487 - DNA, 143 bp, Homo sapiens
  misc_feature 18: n=a, g, c or t
gttgcgcatagtgctagnggcttcgggttcggtcctcgcacccggcagccgcactggtgctgagctgctaggaagcccctatcgccgagctcgttggagcttgaacccattgtcacccctccgactcaccggcccaaaaaaaa

SEQ ID NO: 16488 - DNA, 568 bp, Homo sapiens
cctgccgtaagtatacagtgcctccgggtcgcggtcattttgagcccctgtstggatgacttcttgcggckgtctctactcctctcccttccccgcggtaccttgcacttttctccctccctgccccctctacgagtccaccctccgggccttctgcccctgatcgcttggttttccttgcagtcgcctgctgctgtcgtcgggaggtgggtgaggaaagatgaatgggagggctgattttcaagagccgaatgcagaggttccaagaccaaattccccacatagggcctgaattacattccaacagaggaagaaaggagagtcttcgcagaatgcaatgattgaaagcttctggttcagatctgtgcctttggctgcaacaagtatgttgattactcaaggattaattagtaaaggaatactttcaagtcatcccaaaatatggttccatccctaaacttatacttgctttgtatcatgggatactttgctggaaaactttcttaatgtgaaaacttgccaagagaaattcaagaaacttgaaaattccccccttggagaagcttta

SEQ ID NO: 16489 - DNA, 297 bp, Homo sapiens
  misc_feature 42,45: n=a, g, c or t
attttgagcccctgtctggatgacttcttgcggctgttctancsnscccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattcsaacagaggaagaaaggagagtcttcgcagaatgcaatgctgaaagc

SEQ ID NO: 16490 - DNA, 419 bp, Homo sapiens
atttttttcctgccgaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcmtttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccsscmttggagaagctttacgatcaggacaagcacgacgatcttcaccacctgggcactattatcaaaagtcaaaat

SEQ ID NO: 16491 - DNA, 297 bp, Homo sapiens
  misc_feature 42: n=a, g, c or t
attttgagcccctgtctggatgacttcttgcggctgttctanccdscccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatratgaaagc

SEQ ID NO: 16492 - DNA, 298 bp, Homo sapiens
  misc_feature 42: n=a, g, c or t
attttgagcccctgtctggatgacttcttgcggctgttctanccsdsgsccctccccgcggtaccttgcacttttctccctccctgccccctctcgagtccaccctccggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagc

SEQ ID NO: 16493 - DNA, 189 bp, Homo sapiens
  misc_feature 7,10: n=a, g, c or t
gttctanccnscccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaat

SEQ ID NO: 16494 - DNA, 296 bp, Homo sapiens
  misc_feature 42,45..46,289: n=a, g, c or t
attttgagcccctgtctggatgacttcttgcggctgttctanccnnsccctccccgcggtaccttgcacttttctccctccctgccccctctcgagtccaccctccggccttctgsccctgatcgcttggttttccttgcagtcgcstgctgctgtcgtcgggaggaaagatgaatgggagggctgattttcgagagccgaatgcagaggttccaagaccaattccccacatagggcctgattacattccaacagaggaagaaaggagagtcttcgcagaatgcaatrntgaaagc

SEQ ID NO: 16495 - DNA, 297 bp, Homo sapiens
  misc_feature 45,47: n=a, g, c or t
attttgagcccctgtctggatgacttcttgcggctgttctabccnkncccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatrtgaaagc

SEQ ID NO: 16496 - DNA, 298 bp, Homo sapiens
  misc_feature 42: n=a, g, c or t
attttgagcccctgtctggatgacttcttgcggctgttctancccdcccyctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatratgaaagc

SEQ ID NO: 16497 - DNA, 513 bp, Homo sapiens
ataacattcaggatgtcatcttgaaagcagagaccaaggtcttcaccagagacagtctgccaatggcttgattttgcacttcccagcctatataactatgtactggttcatgaagatgtgcttatgggtttctactctaatgaggtttatataactttccaagacaagggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaaatagaagcaagaatcctgtgagattgggatccatctagtactcttcaccatttggaacaactgcctccagagaatgcttctgacgcatcttggaagaacttggaataacctgaggaaatgggtcgatttgctaaatttaggaaaccaatgttcgatacgtgtgtgatcccaataaagcttatttwacaaaaaagc

SEQ ID NO: 16498 - DNA, 513 bp, Homo sapiens
tgagttctgccctttctgcccctctgctgtctgtgaacataacattcaggatgtcatcttgaaagcagagaccaaggtcttcaccagagacagtctgccaatggcttgattttgcacttcccagcctatataactatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgtttcgatacgtgtgtgatcccaataaagctattaacaaaaaaaaaaaaatgga

SEQ ID NO: 16499 - DNA, 503 bp, Homo sapiens
ataacattcaggatgtcatcttgaaagcagagaccaaggtcttcaccagagacagtctgccaatggcttgattttgcacttcccagcctatataactatgtactggttcatgaagatgtgcttatgggtttctactctaatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaa

SEQ ID NO: 16500 - DNA, 503 bp, Homo sapiens; identical to SEQ ID NO: 16499

SEQ ID NO: 16501 - DNA, 503 bp, Homo sapiens
awaacattcaggatgtcatcttgaaagcagagaccaaggtcttcaccagagacagtctgccaatggcttgawtttgcacttcccagcctatataactatgtactggttcatgaagatgtgcttatgggtttctactctaatgaggtttatataactwtccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaa

SEQ ID NO: 16502 - DNA, 429 bp, Homo sapiens
aagaccagtgagagaacatggcagggtcagatgaggaaagatactctggggaactcacgcacgcagaggaataagaggaagcagtcgttttgcatgtaaagccaggctgatccagagcaggcaggtggcatgcaaaggctgagggactggcaggctggcagcattgcccagaggagctcagtctgggagcacagagacagcgcatctctgggaccagactctgcaggcacagagtgaggaccagcagctctcctctggctgcagcccttgtatataaggctgcaaagctgcaatcatctcgaggaactctgtgcagcagcaggagcttatcccagagggaaacacctggaggaccccgggagtcaggcatcatgggccgcgggtctcagactctgtccaagaagcagtcaggggaagatgccatctttc

SEQ ID NO: 16503 - DNA, 272 bp, Homo sapiens
gaacccagctcttccctacgcggtcggcacatgcgcggcastcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaaaaaaaaaaagg

SEQ ID NO: 16504 - DNA, 305 bp, Homo sapiens
tttttctagggttgttacgaagctgcaggaggaaaatgaaatgaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgascgagatcgtgccactgcattccagcctggagacagagtgagactccatctcatctcaaaaaaaaaaaaa

SEQ ID NO: 16505 - DNA, 439 bp, Homo sapiens
  misc_feature 45: n=a, g, c or t
gatcaacttaaaggcaagaagatgaggaagaaggaagcggasagngtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtd

SEQ ID NO: 16506 - DNA, 484 bp, Homo sapiens
  misc_feature 470: n=a, g, c or t
aggggcccctacaagcggccacaaggatggcaggcttcgcggactcgggctgtcatcgtggctcgtggaacaatgtcggcagctgggtttgaagcagcccacgcccgtgcagctcggctgmwtccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccarggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcaggctccaacacttttagtmtaaagaagatccgcttnctggtgatggatga

SEQ ID NO: 16507 - DNA, 555 bp, Homo sapiens
ggtgacactggattctctccatcatggagggggtgggcctttgcttgggaaaacacaggctttctgcatgtgggttttcctctctatgatcgtgcttttgccggcactattatcccaacattgcctctgattaatgtgcttattgcacagaggacatgcgttgaarggactcaggcccagaggactcaccatactacacctagcttccctctcacccagaagcagctaacctgatgaaacaaatgccctggccttgggaagacttagctatatcctaattggagccaacacccagaaaaaaagaagcactgtcctaaagatagtagatgatttgaatcagcgtgtgatatggggtgctgatttttccaaagcttgaatatatgggtccaggaatcaaggaccaagtgggagtgttttctccactattacacaagatttctcacttacagaatttttatattcttcctctatcaagctctactacctttggttccaacggaaacatgcctgtaccagggccagcascctcgaacagtgactgacaggagctggtat

SEQ ID NO: 16508 - DNA, 477 bp, Homo sapiens
tatccagtgaatcccactccctgggaggtggattcatctctaaattccattagttacttttaccttcagtaaatggtctcagcacaggtactgctccatcccatgagtggccacccaggaattaaaggttcctaattccccaccctctcattgtccctcttcccaaaccacaggtttccatgagcctgggctgttataacaaatctcagtttttctgacaccaagtgagagagtctttcctccccaacacctgtcaatttgtgataccaactggatgcccaacagttcaattcattcctaactgaatgtcagactccacaggtttaagagttcattctcacaagactgtcttcacttctgatgccagccacaaatgaggtatcaggtgtcttggtttatttgtgttactataaaatacctgaggctggttaatttataaagaaaagaagtttggcctggtgcagtggcttacacctg

SEQ ID NO: 16509 - DNA, 362 bp, Homo sapiens
atgcccagaaaatatggtaagctatgttaacaagccatattagatatcaagcattaatatggaaataaaccaggtaactcctgtgtaattgatctttgtggggacttggaggaggggaggtgaatctaaactaggtttagtgtgtgctaaacttaattaatggttaactaaattcattcaaagatatctgtaacttgtggtctgatagtgctggtttttggatatgaatttgtcattaagactacctgggctgactctcttttcggactcagcccacctgcacccaggtgaaataaacagctttattgctcacaaaaaaaaaaaaaaaaaaaaaaaaaaaaammmaaaaaaaaaaaaaaaar

SEQ ID NO: 16510 - DNA, 169 bp, Homo sapiens
aaaagatatctgtaacttgtggtctgatagtgctggtttttggatatgaatttgtcattaagactacctgggctgactctcttktcggactcagcccacctgcacccaggtgaaataaacagctttattgctcacagaaagcctgtttggtggtctcttcacatggacg

SEQ ID NO: 16511 - DNA, 509 bp, Homo sapiens
tacgtttaaatgttgttctagtaaatattcttgaatgtattaaaatggctgaaacaacaagcttgggcttttctagcttgccctccactccctgccgtccctctgacgtcgcataaaccagaacccagctccctcctgggactggctgtggagagaagggcacctctgagccagcctgtggccctaccccaaggcgcacttcctcatgtgggcagatcctgaccaggagtccaggttggcctcccctgggccacagcacatcaccgtgtggcctggggctgtgggacagtgagccctgtaaccactagggttctgtgacagatgccaagaccccagagaccgtggcagagctacccccaggagagcggaagcccctacacagcccagacacatgccttccctgggggctggggagtgtgtctcgaggggttttgtttgttttgaggcatgtatcatcttggaaataattgtcaggatgtataaaatagagaaaaagaaaaaaggtatcc

SEQ ID NO: 16512 - DNA, 421 bp, Homo sapiens
tttatttgttgtttgttttccatgaggttatcggaccatgggctgagctcaggcactttctgtaggagactgttatttctgtaaagatggttatttaaccctcctccaccccatcacggtggccctgagggctgacccggagccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttttkgtctcctttgggtattcacaacagccaggggacttga

SEQ ID NO: 16513 - DNA, 131 bp, Homo sapiens
ctgattgtacttgtaacaatattgtaatgaacggctgtgcagtaggcccagcgctgctgtgtctcgtcagaggaatagcttaccacgaacccctcagcatactgggaatctcttcctgaacaacgaatgta

SEQ ID NO: 16514 - DNA, 193 bp, Homo sapiens
gaaaatggcttctcacctagggagtggaatgttccagcctctgtttcctgcmgtgagtgactctaaaatctaccaagcaatgtagcaacgagactggttcagattatttaccaagggttgggggttttcagcgtaactcacaagagaaataaacttggcagccttgggaaaaaaaaaaaaaaaaaaaaaaaaa

SEQ ID NO: 16515 - DNA, 198 bp, Homo sapiens
gaaaatggcttctcacctagggagtggaatgttccagcctctgtttcctgcagtgagtgactctaaaatctaccaagcaatgtagcaacgagactggttcagattatttaccaagggttgggggttttcagcgtaactcacaagagaaataaacttggcagccttgggaaaaaaaaaaaaaaaaaaaaaaaaaaaaaa

SEQ ID NO: 16516 - DNA, 197 bp, Homo sapiens
gaaaatggcttctcacctagggagtggaatgttccagcctctgtttcctgcagtgagtgactctaaaatctaccaagcaatgtagcaacgagactggttcagattatttaccaagggttgggggttttcagcgtaactcacaagagaaataaacttggcagccttgggaaaaaaaaaaaaaaaaaaaaaaaaaaaaa

SEQ ID NO: 16517 - DNA, 403 bp, Homo sapiens
tttttttttttggcaaggcacagttacggttaaatgattaaggtgggcgtattcgaatgtttatgttttcatcagaatgtaatcaagatgacgcacatttttatagcggctacaatattaaggttttctaaatctttttctcattagaggaccatattcaacgataatattatttatctataacagcgtttttctacaatggacatagctgttcaaatgtttctctttttgtgagagtatcttgggggttttattaatactccacccccatctccattcctaccggcaaaaacagcaaaggcactagaaccttcattgatgactgtctggattggtagtataatgtatttctggaaagtacttcttaaaaaatatttttctactttggatttttttttttttt

SEQ ID NO: 16518 - DNA, 446 bp, Homo sapiens
cttgttctatatgtccatgctctgctccacttctgccccttcactctgcccccacacatcactccagactggccttgtggtcrsagcctggaatgcctrggctgctgggggtctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaagccccgtctctactaaaaatacaaaaattaaccggatgtggtggtgtgcacctgtgatcccagctactcgggaggctgagg

SEQ ID NO: 16519 - DNA, 382 bp, Homo sapiens
aggaaaaagtgtcctccccttttcagacatgtacacggtgggctccatgggaacttctgtagggagaaggagggattacctaaattaagcccgcagttacagaaacaagagaagtggcactttgtgcttgcctagagacatacccacaactacataagataaggggagttgcacagacagctactaataagagaaactactcaaacagctacagagatgaggggagtttcttataaaagcttttgaattcaactctaaaaacagcaacccactagggctcccctctacactgtgcagaggtttcttcttctgcttattaaactttcgctcctatctcaccctttgcatccacgctccttcggtcgtgagamagcgaactcgg

SEQ ID NO: 16520 - DNA, 465 bp, Homo sapiens
aatgagtttagtgcccttatgaagagaaacatgagagagatgataactttctagacaaaatgggaatacaaggtgaagatagccacctgcaaactatgatgtaggccctcaccagacactgaatcttcctggccttgattttggacttcctagcctctagaattggtcttgctctgtcgtccaggctgaagtgcactggcatgatctcagctcattgcaacctccaccttctgggctcaagcaatcctcttaccttagcctcctgagtaactgagaccacaagcatgcaccaccataccaggtaagaagaaaaagttagcactacaatgctatagtcacatttatgtttttgttttcacacgcacttcatatctaagactcagtgggcctcaccaagaaacaaagaatttgctctatcctcaacgttgcaaaatgtctgggcataggctgtgttgcatttctcac

SEQ ID NO: 16521 - DNA, 426 bp, Homo sapiens
agttacggcgcaggcgcaagataagctaggagccgcgcgagtcgtagtgtcgctgtttgcgggtctccgcgcgggaccggggcgcasggggtcgctgaggcgagggtgtcatgtcagacaacgaggacaattttgatggcgacgactttgatgatgtggaggaggatgaagggctagatgacttggagaatgccgaagagttttagtagtgacggggttcaccgtgttagccaggatggtctcgatctcctgccttgtgatccgcccgcctcggcctcccaaagtgctgggattacaggaaggccaggagaatgtcgagatcctcccctctggggagccgaccgcagccaaccagaagcgaatcaccacaccatacatgaccaagtacgagcgagcccgcgtgctgggcacccgagcgctccagat

SEQ ID NO: 16522 - DNA, 178 bp, Homo sapiens
aagctaggagccgcgcrtgtcgtagtgtcgctgtttgcgggtctccggcgggaccggggcgcmgggggtcgctgaggcgagctcatcatcaccgactgagctggagtcatcttcctgcccttgccccatgcccaattttcattctcactttatatgtgtaaataataaaatattcaac

SEQ ID NO: 16523 - DNA, 193 bp, Homo sapiens
caccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaaaaaaaaaaaaa

SEQ ID NO: 16524 - DNA, 457 bp, Homo sapiens
attttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgkagtaagacaccaactgcttaaaacataaggatgtttcagttcctccatttaacagatatgaagagcattttaagaggtgcagctctggaagtggatcaaactagaactcatatgccatactagatatgtttgtcaataaacttatgacgtgaaaaaaaaaaaaaaa

SEQ ID NO: 16525 - DNA, 413 bp, Homo sapiens
aacgaagtcctgtcggtccctaccggcacatcacacactcctggaagcatgatcttcactcccttccttccacctgctgacctgaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttgactgttaaaaaaaaaaaa

SEQ ID NO: 16526 - DNA, 538 bp, Homo sapiens
gagaggattgttgtagcaggaaataatgaggatgtttcattttcaagaccagcagatcttgaccttattcagtcaactccctttaaactcctcgcactaaaaacagcacctcgtgtacttaggctaagtgaaagaccactagattttctggatttagaaagacctcctacaacccctcaaaatgaagaaatccgtgcagttggccgactaaaaagagagcggtctacgagtgaaactgctgttcgccaaaatggacagctggtcagaaatgattctctttatggcatttcaaatacagatacaacaattgaaggaacatcagatgacctgactgttgtagatgcagcttcactaagacgacagataatcaaactaaatagacgtctacaacttccggacgaggagaacaaagaacgtgctaaaagagaaatggtcgtgtattcaattactgtagctttctggctgcttaatagctggctctggttttgccgctagagatactgctgtggtctgggagcaaagtctttgaagacttacc

SEQ ID NO: 16527 - DNA, 69 bp, Homo sapiens
gattgttacagcagagaacaacggagacattctgttttgaagaccagtggattttgactttattcagtc

SEQ ID NO: 16528 - DNA, 439 bp, Homo sapiens
tacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattttgtcactcagctgtattcacgtctgagcagttctgcagtaacacctgcttaaaattctccctttgcat

SEQ ID NO: 16529 - DNA, 430 bp, Homo sapiens
aacgaagtcctgtcggtccctaccggcacatcacacactcctggaagcatgatcttcactcccttccttccacctgctgacctgtctgtctttcagaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttgactgttaaaaaaaaaaaaaaaaa

SEQ ID NO: 16530 - DNA, 470 bp, Homo sapiens
tacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattttgtcactcagctgtattcacgtctgagcagttctgcagtaacacctgcttaaarattctccctttgcatgttttgtaaataggctccagttttgttttt

SEQ ID NO: 16531 - DNA, 503 bp, Homo sapiens
tacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattttgtcactcagctgtattcacgtctgagcagttctgcagtaacacctgcttaatrattctccctttgcatgttttgtaaataggctccagttttgttttttaaaaggaatttattttttgcctcatcagtcca

SEQ ID NO: 16532 - DNA, 350 bp, Homo sapiens
agtggatgctttggcaagatggcggggagcggcgtccscaagctacttaccgccagcaccttcgtgaagcccattttcagtcgggacatgaacgaggccaagcggagggtgcgcgastctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacaaagcgc

SEQ ID NO: 16533 - DNA, 422 bp, Homo sapiens
aacgaatcctgtcggtccctaccggcacatcacacactcctggaagcatgatcttcactcccttccttccacctgctgacctgtctgtctttcagaatgtgaaagggctgcaaaacgaccctgaggaatgggtggctgtgtctgacgccacggaggacccatccggtggcacaggcttgcccagggracctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgstccatgcccctgctcgccgcagtgtcccagtcaccaggcctgaaataaatgctggcacgcttgactgttaaaaaaaaaa

SEQ ID NO: 16534 - DNA, 159 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaa

SEQ ID NO: 16535 - DNA, 193 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaaaaaaa

SEQ ID NO: 16536 - DNA, 213 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaattggcatcatcggcggtgaaaaaaaaaaaaaaaaaaaaaaaaaaaaaaaaaaaaaaaaaaaaaaaaaaaaaaaa

SEQ ID NO: 16537 - DNA, 194 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtwaaatggcatcatcggcggtgaaaaaaaaaaaaaaaaaaaaaaaaaaaaaaaaaaaaa

SEQ ID NO: 16538 - DNA, 185 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaa

SEQ ID NO: 16539 - DNA, 187 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaa

SEQ ID NO: 16540 - DNA, 190 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaaaa

SEQ ID NO: 16541 - DNA, 165 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaa

SEQ ID NO: 16542 - DNA, 188 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaa

SEQ ID NO: 16543 - DNA, 168 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaa

SEQ ID NO: 16544 - DNA, 410 bp, Homo sapiens
  misc_feature 122,146,152: n=a, g, c or t
gtcttcaacgaakcctgtcggtccctaccggcacatcacacactcctggaagcatgatcttcactcccttccttccacctgctgacctgtctgtctttcagaatgtgaaaggkctgcaaawngaccctgaggaatgggtggctgtntstgwngccacggaggacccatccggtggcacaggcttgcmcagggaactgctcttctgcvagggtcttggaggagccggttccagagagccatggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgctt

SEQ ID NO: 16545 - DNA, 173 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaamaaaaam

SEQ ID NO: 16546 - DNA, 191 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaaaaaaaaaaaaaaaaaaaaaaaw

SEQ ID NO: 16547 - DNA, 168 bp, Homo sapiens; identical to SEQ ID NO: 16543

SEQ ID NO: 16548 - DNA, 170 bp, Homo sapiens
atattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgaaaaaaaaaaaaar

SEQ ID NO: 16549 - DNA, 442 bp, Homo sapiens
ataattttcagagccagccgggagtgcaggagggagaactttcctgtggacgtcctgtgttctccagacgcagagaaccctcatcaaccgagggggaggtcacttccgaatccacagatggcgtgtgagtgcatggcgagcgcctccaggacacacttactgttcccttgctctggccagacgccagccggaccctgtgtgtgcgcgccgtgctgctctttgcagctgcctgcaagggttcctgcgaagaccagcaccttggggaagagcctgcgctgaacttgaactcgcagctacctgagtcagacctgtgctttttcacctctacggaagatgtcagagcgtttccctagcaatgttttagaagttacttctgtctggaaaaaaatggaaaaaatggcaaattatgttatgtataatttgataattttaaagaattaat

SEQ ID NO: 16550 - DNA, 235 bp, Homo sapiens
  misc_feature 50: n=a, g, c or t
aactgcaggccgggaccgactgtcttgacgttcacgacccccgcccaagnggaaagcggccaagcttccgcgggccccaaggggcmaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaaaaaaaaaaaaaaaaaaaaaaaaaaaw

SEQ ID NO: 16551 - DNA, 201 bp, Homo sapiens
aactgcaggccgggaccgactgtcttgacgttcacgacccccgcccaaggkgaaagcggccaagcttccgcgggccccaaggggchaaaggctcaccagatgtaagaccctgaagacctgagatgtccacggagcccttaactccacggaagaataaaccaccaccgctcaccgaaaaaaaaaaaaaaaaaaaaaaaaaag

SEQ ID NO: 16552 - DNA, 192 bp, Homo sapiens
aactgcaggccgggaccgactgtcttgacgttcacgacccccgcccaaggggaaagcggccaagcttccgcgggccccaaggggcaaaggctcaccagatgtaagaccctgaagacctgagatgtccacggagcccttaactccacggaagaataaaccaccaccgctcaccgaaaaaaaaaaaaaaaaaaa

SEQ ID NO: 16553 - DNA, 184 bp, Homo sapiens
aactgcaggccgggaccgactgtyttgacgttcacgacccccgcccaaggggaaagcggccaagcttccgckggccccaaggggcaaaggctcaccagatgtaagaccctgaagacctgagatgtccacggagcccttaactccacggaagaataaaccaccaccgctcaccgaaaaaaaaaaa

SEQ ID NO: 16554 - DNA, 539 bp, Homo sapiens
  misc_feature 502: n=a, g, c or t
acagagaggaaagacagtggcagatggagacgtataaagcagggatcctgttatgaaaagccctaaaaaatagggtatagagtttgggccatatttcagaggtaataagaaagcattctgcatttttaaagtaaggtttaaaaatgtttctaattagagatacagcaaagttggtgtgagaggataaagactgatatacataatctgaggagttcatgaaaattccatgtaaagcctgtagtatgaattggtcctaggagacagacagcttcaggggcatagagaactttaagcacttttccaagaagagtgaagggctggagaataaattgtgaactaaaatatattttgtgtttgagaacatgaagtacttgagagtgattattacacggttttaagaaaaaactagttcttttaaataaaacttttttttagctgagcacagtggctcacgcctgtaatcccagcactttgggaggccgaggcaggcggatcacctgangggtccggggagtcgagatcagcctgaccaacatggg

SEQ ID NO: 16555 - DNA, 179 bp, Homo sapiens
  misc_feature 24: n=a, g, c or t
aactgcaggccgggaccgactgtnttgacgttcacgacccccgcccaaggggaaagcggccaagcttccgckggccccaaggggcaaaaggctcaccagatgtaagaccctgaagacctgagatgtccacggagcccttaaactccacggaagaataaaccaccaccgctcaccgaaaa

SEQ ID NO: 16556 - DNA, 231 bp, Homo sapiens
  misc_feature 16,50: n=a, g, c or t
aactgcaggccgggancgactgtcttgacgttcacgacccccgcccaagnggaaagcggccaagcttccgcgggccccaaggggcaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaamaaaaaaaaaaaaaaaaaaaaaw

SEQ ID NO: 16557 - DNA, 234 bp, Homo sapiens
aactgcaggccgggaccgactgtcttgacgttcacgacccccgcccaaggggaaagcggccaagcttccgcgggccccaaggggcmaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaaaaaaaaaaaaaaaaaaaaaaaaaaw

SEQ ID NO: 16558 - DNA, 182 bp, Homo sapiens
  misc_feature 50: n=a, g, c or t
aactgcaggccgggaccgactgtcttgacgttcacgacccccgcccaabngsaaagcggccaagcttccgcgggccccaagggchaaaggctcaccagatgtaagaccctgaagacctgagatgtccacggagcccttaactccacggaagaataaaccaccaccgctcaccgaaaaaaaam

SEQ ID NO: 16559 - DNA, 233 bp, Homo sapiens
aactgcaggccgggaccgactgtmwtgacgttcacgacccccgcccaaggggaaagcggccaagcttccgcgggccccaaggggcaaaggctcaccagatgtaagaccctgaagacctgagatgtccacggagcccttaactccacggaagaataaaccaccaccgctcaccgaaaaaaaaaaaaaaaaaaaaaaaaaaaaaaaaaaaaaaaaaaaaaaaaaaaaaaaaaaar

SEQ ID NO: 16560 - DNA, 472 bp, Homo sapiens
gattaaaggagaaaccaccatattaagagatttagaaacattatagacagctgtaaaacaaaagtcagaataataaatttgcttaggtacaggtgagcttgttggagcttttaaaaaatgcttgacatgtcaagtgaataataaattattttcagtattttattggtattttgaacatcacatttctatgaatttcaagcaagtttgtaactgcattgagatcatatttttataggtagaacaacaaaagtatatagagctcaacaaaagtatatagagctcaggggcagcttttgaagtcagagacggagaaaaatctttgtttatcaaaatagacgtatatgatttatttttaatttttaaaaagtatctattstgttgytattatttttttttagagacagggtttcactctgttgcccaggttggagtacaatggcatgatcattgcttactgcagccctgaactctt

SEQ ID NO: 16561 - DNA, 903 bp, Homo sapiens
ataaatccattcaggtgacaaccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcagaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagct

SEQ ID NO: 16562 - DNA, 436 bp, Homo sapiens
aatgtttatgccctatcgccatggtgacgggattagggatctcctgctcttggtcctaagagccactgtctgtgctgtgtttttcaaaggtcagcacagattgaacctttgtggttttattatccctgagtttgatttttctcatggggaacctgtgttgctgctttgaagccgttggacctcacaatgtggattgtgccctcaccctgcaatgtttatgccctatcgtcatggtgacgggagtagggatctcctgttcttggtcttaagtgccaatgtctgtgctgtgtttttcaaagctatgtttccagtgtcctctgggtgtttccaagagcaacaagaaacgaataaatctctgctctggggccaagctgcatcacaatggaaatcatggagccacaggaagaatccactcagctttgcaacatgctgccca

SEQ ID NO: 16563 - DNA, 438 bp, Homo sapiens
  misc_feature 381,389: n=a, g, c or t
taaaatgggagggggagacgcaagatggcggcasccgaactccggctctagctcccgctgttcgactgcccaacctgggcargtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtagcttagaacctgacagagttcaacactgcccacaacaagcggatttctacccttaccattgaggagggaaatctggacattcaaagacnaaagaggnaagagcaagaactcacgggtgacattcagtgaggatgatgagatcatca

SEQ ID NO: 16564 - DNA, 417 bp, Homo sapiens
aaaaaaatgggagggggagacgcaagatggcggcascgcgaactccggctctagcctcccgctgttcgactgcccaacctgggcaggtaagccccctcccggtttacatctggatgtagtcaaaggagacaaactaattgagaaactgattattgatgagaasmaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctc

SEQ ID NO: 16565 - DNA, 222 bp, Homo sapiens
tcctccgcggctccgccaccatcgcggaggtgccgctgttcccacagacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggawwaaaaaaaaaaaaa

SEQ ID NO: 16566 - DNA, 431 bp, Homo sapiens
ctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccggccccggggcatgggcacggcctgaagctgttgctgggggccggcscsgtkgsctacggtgtgcgcgaatctgtgttcaccgtggaaggcgggcacagagccatcttcttcaatcggatcggtggagtgcagcaggacactatcctdgccgagggcttcacttcaggatcccttggttccagtaccccattatctatgacattcgggccagacctcgaaaaatctcctcccctacaggctccaaagacctacagatggtgaatatct

SEQ ID NO: 16567 - DNA, 112 bp, Homo sapiens
ttggaggcctgaaaccaccggaacgaggtggggcacttgtttcctgagtccgggctggaaatctcggagttaccgattctgcggccgagtagtggagaaagagtgcctggga

SEQ ID NO: 16568 - DNA, 606 bp, Homo sapiens
  misc_feature 590: n=a, g, c or t
agtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaacccttcttgttcaggactgtcatagccacagtttgcaaaaagtgcagctattgattaatgcmatgtagtgtcaattagatgtacattcctgaggtcttttatctgttgtagctttgtctttttctttttnccttttcattacatca

SEQ ID NO: 16569 - DNA, 161 bp, Homo sapiens
actctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggc

SEQ ID NO: 16570 - DNA, 469 bp, Homo sapiens
ctaatcgaaaaagagccgccgcccgcgaggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaaga

SEQ ID NO: 16571 - DNA, 484 bp, Homo sapiens
acttttcctggctgtagagcgctttccccctggcgggtgagagtgcagagacgaaggtgcgagatgagcactatgttcgcggacactctcctcatcgtttttatctctgtgtgcacggctctgctcgcagagggtgagagcgggtatttctcagacgtttgatcagtccccgggaggaagggccccggggtcccctgtgccaccaggggaaagatcgcgagccttacttgcttgagaggctcatctactccacttcagggaatctctgggcaactcgtgaacaggagcaggaggggagtatggagtcgattgccgagttttctttggtctcaggcataacctgggtcctggtttacaggacagacaagtacaagagactgaaggcagaagtggaaaacagagtaaaaaattggaaaagaagaaggaaacaataacagagtcagctggtcgacaacagaaaaagaaaatagagagacaagaagag

SEQ ID NO: 16572 - DNA, 461 bp, Homo sapiens
taactagaaaaacagcagcatgaagtgtggattggagtacttaatggtggcacctgggcaaattattctaggcatgtctgcacagacctcaaatgatggaggagtttccctacacaagccctctctttgcctggtgccatccaagtaagacgtgagttacttctccttgccttccgccatgattttgaggcctccacagctacatggaactctgccatgtcatgggcagcactatggagcaatacacgtgacaagccttttgccaacaaccatgtgagctgctgagtctccttagaagagccaagaagccttctcagaagtggatctatactggctgtatagcatcctgccccgctactgtatgtcacaccacctcaaacagtcccttttgttggaatttaaattccagtttttcaaaataataactggcacaataaaaatagtgcaaattaaaaaaaaaa

SEQ ID NO: 16573 - DNA, 222 bp, Homo sapiens
gaacagaggaagaatctgttgtcagactaaattattctggttcaaaatgggctgttttttgagatttcagtggagaggaaaaaaagtgtttaagtattttcaagagaggtaacctcgctcggtgagccccgcccgcgatccacgctctctgggagctaggaggggcgcaggagccggggtctctgccctgcccgcctggcttccagatgtggtgcagcgcca

SEQ ID NO: 16574 - DNA, 495 bp, Homo sapiens
agctgggctctcaggcgctgccggagagagaaatgccccaggctctccggggcacacaaagcgcaggcgcasgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagaaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagaggccggagccgagatggcctgctgactgtgaacctacgggaaggcggccgcytgsacctctgtgcggagaccaaggatgatgccctagcatggaaagacagcactgctggag

SEQ ID NO: 16575 - DNA, 471 bp, Homo sapiens
aaaagcgcaggcgcasggggttgggtggcagcagcatcgagtagcggccgcttagsagcaacatccgcaacaagtgtagacaagctgtacattggaatcatctgaggatctttgaagagtatcagggcttgcctcctgccctcagacattctgatttaattgttacggagtgtggcctggtatcggaagttctcaaagctcctgccggcataacggtttgaagccaggactgctgggtcccgcctgactccgctctggaaagtccttttgaagaaatggccctggtgaggggcggctggctgtggagacagagctccatcctccggctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcag

SEQ ID NO: 16576 - DNA, 396 bp, Homo sapiens
actcagtccacagcattctctggtggcagacgctcaggaggagataataatccctgtgttcctgggcgagtcagtgccacccgagatgttggcggccactttggctgagctggacggatgcttgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtctttttctggctgtgggaccctgtgtgagtcacttctccttctgagcctcagtgtcctcatctataaaatggggctttacaaacccctcaccgcagcta

SEQ ID NO: 16577 - DNA, 403 bp, Homo sapiens
  misc_feature 396: n=a, g, c or t
actcagtccacagcattctctggtggcagacgctcaggaggagataataatccctgtgttcctgggcgagtcagtgccacccgagatgttggcggccactttggctgagctggacggatgcttgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcacgcacgatcnaaaaaaa

SEQ ID NO: 16578 - DNA, 458 bp, Homo sapiens
  misc_feature 356: n=a, g, c or t
aaacattatcctccttttcagaaggcaagctaaggttcagagaggctgtgatccctccaaggccactcagtccacagcattctctggtggcagacgctgcaggaggaggtgtcccaaactggtgggaacttgactggaaggctggggttaaggatgaactttctgccgtccagactgtcccctgcagagcagctgctgccagacagcgggagctcccacttcgtgcacaggatgggggcagggagcccgcagccgcggaggcaggaatgactgtccgggaacctcctttcttctccctgaatcccagccctggcatctcaccagggggcacagtgatggtccagggctgggcccgngactctagctgaatctttcagagtatcccatccctctggccagtggccaagcgagtgaaccagaatgcttccttgggagttttgaaactggaactggagaga

SEQ ID NO: 16579 - DNA, 508 bp, Homo sapiens
tttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcga

SEQ ID NO: 16580 - DNA, 342 bp, Homo sapiens
  misc_feature 319: n=a, g, c or t
gctatcctccactggttacccgggttccccggcttgctaccgggctgctccgtgcatctttccccccaggcgtcaggaactgcgccctcatggcggaggtgaaggtgaaggtgcagccgcctgacgcgatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaangactctcagaatgctggtaaaat

SEQ ID NO: 16581 - DNA, 356 bp, Homo sapiens
  misc_feature 230..231: n=a, g, c or t
atatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttannagggacctgccacttttgactgtggatcagttgatgtacacttgtattattaaagcactcaataaatcactgtggctgaaaaaaaaaaaaaaaaaaaaaaaaaaaaaaaaaaaaaaaaaaaaaaw

SEQ ID NO: 16582 - DNA, 382 bp, Homo sapiens
tctctttaaagaatcagtatgtcagtatgttcaattctttgccttctacttgtaaacttaacttcctcataaagcaacctttttcrattacctgctccatcctgactcattccgatttcctgctctgccataaccatttttcccgccaaaccactcaccctgtcactctctttaaattagccagttggagttagtttggcctgtgtggtctaaccctagccaataggggaatgacacagcagcaggggccatgtgcatcagggataagaaccctttcccctcccttgtccaggtgtgcactcaaccattgctccatctgtaagggcgcacccttctgtagaagtacattgacttgctgagaattaaaaagaaaatttcaaaa

SEQ ID NO: 16583 - DNA, 488 bp, Homo sapiens
ggtattcctacaggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctccttcgtgaagctaatcaagcaattaatcccaagttgcttcagttggtcgaagmagaggttcaggtcgttccaggggtagaggaggcatgaaggatgaccgtcgggacagatactctgcgggcaaaaggggtggatttaatacctttagagacagggraaattatgacagagg

SEQ ID NO: 16584 - DNA, 448 bp, Homo sapiens
attttcccatctttcttttcattccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgcaaaaa

SEQ ID NO: 16585 - DNA, 447 bp, Homo sapiens
aaaaaaaagaagatgawttagtagagcatgaagaataatgaatgagttgctaggtaatttgccattccctctgcctggatgccttttcctccaattgccagttagttttaaggccaccctyctctgaaataacatagtactttgtacttgggtcatggtatttatcacagacttccttttattatagttaattctgtacatgtttaatctttcttacttgattctaaactctttaaggacagggtccacatcttatcttcatttccttcttcsagctcttaacaatctgtgatgttaagcatatttgaaaatagacattgttagagattatgtycttttagtgaaaaatcggccaggtgctgtaatcccagcactctgggaggttgaaacagarggattgcttgagcccaggagtttgagatcagcctgggtaacatggtgaaacct

SEQ ID NO: 16586 - DNA, 157 bp, Homo sapiens
  misc_feature 96,115,118: n=a, g, c or t
agaaaaaacttgtgcggggccatttttggggcagtaagatcgagcgaggagcccaagagckagcgcgcagcacgaagctcgagccgmctccgccgngcgaccccacctcggrcgncgncgsctgsgccgsgagatccgccccggvctccccgagagc

SEQ ID NO: 16587 - DNA, 365 bp, Homo sapiens
acaggcctctctggctccactacaataagcaagaagaaactgccatctctttgtacacctaattgtagaagtgatattccattacttttgccatgttctattagttagaagtgaatcactaggttcagcctacattcaagaggaagggatcacacaaagatctaggaggcagctactcctcacctcctgactacgacagccaagtccaggctgcagtatctcttgcctggactctgctgcaatagccttctatcaaggttcctgctcctgcttcccttccccagtgtattctacagccagccacagccatctcttagaagggtaagtccgccgtgcctctcctctgctcaaagcctactttgctg

SEQ ID NO: 16588 - DNA, 381 bp, Homo sapiens
aactaaatgatgtgctgtaaatatctttccaagttagtatatatagatctgccttaagttctttttaattgttttgtatggatgtgtcacaatttatataataatattccaccggataaaatttaaattgtttttattattttacaatgaataccacatatatttcttggacattagtgcaaacttttaaaagtataattcttagaaatgtattactggaaaaaagatctaggaggcagctactcctcacctcctgactacgacagccaagtccagsttgcagtatctcttgcctggactctgctgcaatagccttcwwcaaggttcctgctcctgcttcccttccccagtgaattctacagccagccacagccatctctt

SEQ ID NO: 16589 - DNA, 499 bp, Homo sapiens
taaagcagtggcaggagctgctgtctgatgacttcccacctcaagtccattttgtccctcacatctcttttactaagagttcttgaatctctttctctgcttttcctgaaaacaggccaaggttgagaccactggacttccatctgatttgagtgttctgcactgagatacagctgtggttagagctgctgtgggaagcacagccatcagttcctatggagcggcacccattcttgtggtagaagacttgcggcatccatgtgcctgctttgttatgctgttatggtccttgattctatgaaatagccaacatgaaattatgatcagttaaggtaacagaaatggggctttttcactgaaatagaaagaggattctagcagagtcagaaactgctggtgatttctgcaaatatggtagggaatagggaatatgtggctgtttcaagagcacaaattaaatgacagtactgcttccatgcagcgtgttgacagattgaga

SEQ ID NO: 16590 - DNA, 421 bp, Homo sapiens
gagttcagtgaccccctgctttcctctgcccctcccttcccaaggcattgaagctgaatgtgccaactggcagttagaagcgaaagatggcattgggagaaattttagagagctttcaaactctttattctcatgttccacatggtctaattttaacataaataatatgscttcacactggattgtaaaaggcatgtgatttttgagattttattttgtgatgtattgtcttctgcagtattaaagggaaagaggtattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaaaaaaaaaaaaaaaa

SEQ ID NO: 16591 - DNA, 515 bp, Homo sapiens
acatttcccagaatgcagtgagggtagcgaccgggctacacagtagaaaccctatctctactaaaagtacaaaaattagccaggcatgggggtgggcacctgtattcccaactactctggaggctgaggcagaagaattgcttgaacccaggaggtggagattgcagtgagccggaatgcaccactgcactccagcctgggtgacagagcaagattccatctcaaaaaaaaccatactctgttaccattaggcaagagataatcataataaatgttccaatagccaaactctaggctccaaaaattataataaaattataaaaatggttcacaataacaaaaatgtaacacctaatgcattgtacaatctgaactgtataaagacaccgttaatttagtacataattgtcaaaccacttctataagttaggtttggcaaattgcaggagacaaagatggaattgacatagtttttgtctttaaggtgctcataatagaatatagataactattta

SEQ ID NO: 16592 - DNA, 506 bp, Homo sapiens
  misc_feature 22,387: n=a, g, c or t
atctttgttgggggcagccagnctggstcgagatgccgaagtcgtgcgcggcccggcagtgctgcaaccgctacagcagccgcagaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccgnagaggacagtcctgggagaaacatggacactgcacttgaagagcttcagttgcccccaaatgccgamsacgtaaaacaggtctcgccacggaggccgcaagcaacagaggctgttggcc

SEQ ID NO: 16593 - DNA, 187 bp, Homo sapiens
tatttataaagatctggcctgttcctgcgtctgcggasggcccttgtctcccagctatctataaccttagctagagtgtcgccttgtgggttcctgttgctgagacttcctggatggagccgccctcaccgccgggcccgtggctgcgcggastgtgtccaataaagttcttggatgtgaaaaaaaa

SEQ ID NO: 16594 - DNA, 106 bp, Homo sapiens
tcakggctskttactggatgkktatttataaagatctggcctgttcctgcgtctgcggagcggcccttgtctcccagctatctataaccttagctagagtgtcgcc

SEQ ID NO: 16595 - DNA, 510 bp, Homo sapiens
attctattcttagttttccatgtcacctcattggaagagacgggaagaatgtgaaaataatgggattgcagacatctggaagaattttactctaaccatgaaggattcaaagcaagtgtttccattagaaaacactacatgaacaccaacacaaaaagattacaggtgtgagccatggcaccccacaaatgcatgtacatgttttaaatgcagatacctgattcctttccacatccacacccctactccaagacctacaggaataatctccagagatggaacccaggcatatgtacttttaacaaaattgctttgtgattccaatttataccaaagtttaagaatcagtggacaccactgccctgttgctccagaaattgttttcttaggagtgataatgattcaaaagcttctgactagttttctctctttccctcccaaatcatgcctgacacttgtgccacctgattctttgtgacgggagattttttaagatagatgtggtatgga

SEQ ID NO: 16596 - DNA, 422 bp, Homo sapiens
caggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagtctgtatttattaacatcagtttgtttatttattcagtaaatattgaatgcctgttctgtgtaggtcattgtcttggcagttattttgagctcttgctacctgctgaattatatcttaaaatgaagraatttacatgatagagtgatatttawtcatcygtgcygaagattaaagtgagaagtatgtggcargcgcggtggctcacgcttgtgatcccagcactttgggargccgargtgggcggatcatgaggtcaggggatcgagac

SEQ ID NO: 16597 - DNA, 574 bp, Homo sapiens
aattttctcttgctgctaccatggaagaagcgactttcgcctcccgccgtgattctgaggcctttccagccatgtcaaactcaaaatgtgactgaaaaacagaagcatttggaatacgtaacagaagtcattaaaaagaggagatgtcccagtttcttaattcacggaataaaaaaaatcaagccatcttattctgtcatgatacccttatcttctttcagccgtattacaagtgtttccacatattccaaatccccatggggtgaaggaataaaagaagaaagtcactccatatatttcaggcttctccttttgttgaagaacagtttgtcttgattaaatcagcagtctactgatttggtcatcttctccaatgttgcctgccaacaatgcactattttcacttttgctaaagtaatagttctaagaatgagaaatttagacagctctgtcagaagagatcactgtccattaagtggaagtggtggacaaggggagaaacagttggtgttttcaagtaagagtaccagaaaggcagaaaggagagacctacttaaataaagaagaagaagaa

SEQ ID NO: 16598 - DNA, 355 bp, Homo sapiens
ataaagtacctggcggactatttctggaggttacagttttgttattaaaaaaaaatacacaaataatgggtctggaagaggaagcataataaatttgaggactcagaagtgatgctaaatttggacatttgaagaaggggcacaggaaagcaattcaaaggcacttgagttatcaacgtgcacagaggaaattaagtaggaggcatgttggaaaggcacccactgatatcgacctggatggaagcccctgaagtcgcagttcctccacagcatgggctttgaactcctgcgcttgggtctggcttccacaaagatgaactcagaatggaaaaattaaaaaaaaaaaaaaaaaaaa

SEQ ID NO: 16599 - DNA, 404 bp, Homo sapiens
tctctcggcatccacctccttcccctcctcctgctcattcactctttccctcactttctcccctcctcctcggcttctrccccgcgccccgccagccctcgcgctctcccactccctctgcctgtsctccccggtcccctcctcccgctcattccactcgcccctctcccttctccactctctcmccctgtctcctttcttcttcttctttcaccctccgtctctcasaccccctccattcccctgtctcctttctgacactgcactgcagctgctcctcagccctgccccctccccagtgagaacaaaccagcaacattgctttttttcctaaagagatttatattgatccgattaaaaaaaaaaaaccttaagaaaccccaaacrcaaaaagaaaaaaaaaa

SEQ ID NO: 16600 - DNA, 442 bp, Homo sapiens
gatccggacccggagccagcgcggasacctgcgcccgcggctgacaccttcgctcgcagtttgttcgcagtttactcgcacaccagtttycccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcactgattgttaaggaatatcaagcagcatatggaaaggagctgaaagatgacttgaagggtgatctctctggccactttgagcatctcatggtggccctagtgactccaccagcagtctttgatgcaaagcagctaa

SEQ ID NO: 16601 - DNA, 487 bp, Homo sapiens
acctgagcggcgcatcctcagggcctgggcctggcctccttgcctgtgagatggcactgtgacggtgcccacctcgtggggtgtgtgagggccgagtgaaatcgtgcatttgcggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttgtctgagcaaatggctcattttaaagatgacttgcagacaaatgtagagatcatcccaggggaaagtgccccaagaaaggagagtccaagaccacctgcccctcccagttctgcggctggagtggg

SEQ ID NO: 16602 - DNA, 275 bp, Homo sapiens
ccatccaaaatggtgtttaatctttattttggctgcaacttaaatgctttgacaccgcagcacctccttcctcttgggcytgattcatcaggtgctcctggaaacaggtaatcctgcagcttcacaccagccctgtcagtgaggctgtggccatcagaggtaaagaactcctccttctgggtccttccaaaatcaccttgactttctctctttacattgaaacctagtacaagaccataaaaatgtgtcctgtaattttctctctctcttttttt

SEQ ID NO: 16603 - DNA, 343 bp, Homo sapiens
agccgactcttactcctcctccccgcaatcgtcgggtggttagttgcacagcctcgcgcatgggcacttttgttatttttcattatgtagtctgcagctgctggaggaaagacaagaaaaaaaaagaagggacaaaacgattaaagttttggggtgaaaactccagatcctttaatgatttttcctctcgaatcgcaaaccagccagggcgtgaactgagggcggtgagggggtacgggcatctccctgcatgcaacgcggtttttgtataaactacaaatcccagcatgccactctctctctctctctttttttttttttttttttttttttaaaaaaaaaa

SEQ ID NO: 16604 - DNA, 468 bp, Homo sapiens
aacatargactgtttagggagacacagttcagttttcatagcagtcatggtagatggttgcctgttcatttgtttccaaatagacttaagtttcttaatcttaaattccttcattggggcttggagacctagatacaaacaccattaattttgtgaagaagttatctctggsytactcccttcaaaggcattattattatgaaaccaagggttgaccatttctccaactgtcgtcccgaagaacaaaccctgattttcagccattaccctagacagtgccagcttaaacctgattatgtaaagagacacatcagcactgtcttgtagcactttctgtgctgatatacacggcctataaaatggtttatgaaatctgcactgtctaatacagttgccattagctacattcagctattaagcacttgacacttgaccactgtgactgaggaattgtattttttattttat

SEQ ID NO: 16605 - DNA, 244 bp, Homo sapiens
gtaatagagcttcgacggccgccattttctttctttcttagctgttagctgakbaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaaaaaaaaaaaaaggc

SEQ ID NO: 16606 - DNA, 399 bp, Homo sapiens
atatacctgggcccagctcacaaccacaatgatgactctcttacctggacacagacagtgggagatattttgacttttgtagccaggcttaggccataggtggtttggtgactctcgaaccatgattcggcagacctgtgaggctgtgagttccctattggaacacaatctgcaggttgtattgtgccatatacctgggaccaaattacaagcacaatgatgaattttttacctggagtcaagacatgtgcaggatggtggaacttatcactggacctttccacagtgttattatgacatataactttgtccaacatgtgagtaatttgactctccagatggcccagttcacaaataaaattggacagatacctgggccaagawaaaaaaaaaaaaaaw

SEQ ID NO: 16607 - DNA, 352 bp, Homo sapiens
gaggcgaggcggggagcgcaascggcggccactgccacgtattcccggcagtggtggcggcggcggcggcggcgccgcgrgcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccaygctgg

SEQ ID NO: 16608 - DNA, 348 bp, Homo sapiens
atttgggctgtgttctcgctgcgaggaggaagccaggttacctctgttggacctgcctgctcccagcatctccagcaacaagctgtctctgccggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagctaagccatgcaggatggcccggcagcagatcactacagtg

SEQ ID NO: 16609 - DNA, 377 bp, Homo sapiens
gaggcgaggcggggagcgcaascggcggccactgccacgtattcccggcagtggtggcggcggcggcggcggcgccgcgagcaggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccaygctggssgtkttcgt

SEQ ID NO: 16610 - DNA, 224 bp, Homo sapiens
ctctcctctctcctttctcttggaccctttgctctggggaaaccagctgctacatcaccatcagccttgtgaccatgccacatggtgttccacagacatcctacatgcatgacattgattcactcttacatttgacaggattgcaggagctcctcagacaagatctgtggcaacagtaacaataaaagcatcccatgcggaccaaactcctgctgcaaaaaaaa

SEQ ID NO: 16611 - DNA, 276 bp, Homo sapiens
ctctcctctctcctttctcttggaccctttgctctggggaaaccagctgctacatcaccatcagccttgtgaccatgccacatggtgttccacagacatcctacatgcatgacattgattcactcttacatttgacaggattgcaggagctcctcagacaagatctgtggcaacagtaacaataaaagcatcccatgcggaccaaactcctgctgcaaaaaaaaaaaaaaaaaadaaaaaaaaaaaaaaaaaaaaaaaaaaaaaaaaaaaaaaaar

SEQ ID NO: 16612 - DNA, 440 bp, Homo sapiens
tacttctgtcccaggtcacccaaacattgacctgtgtcggttccccactaggaacaaaatgtaactgaggacgttgtcagatgcttgtcctcgtcaccctgagcttgttggctgctatctaattcttattctttcattttcttgcccgcacgttcttgatagcagatcactgacaacagccattggaagcttaggaaaagggtatgtgccgggcgcggtggctcacacctgtgatcccagcactttgggaggctgaggtgggcggatcacgaggtcaggagatcgagaccatcctggctggcacggtgaaacgtctctactagaactacaaaagttggccgggtgtggtggcggtcgctgtagtccagctactcgggaggctgaggcaggagagtgacgtgaacccgggaggtagagcttgcagtgagcagagatcatgc

SEQ ID NO: 16613 - DNA, 467 bp, Homo sapiens
caaacaaaaaacccgtatgttgacagtgcactaaaggggtaagcctggaaaagtggagaggattttacagaaaggggaatcttttttattattttaatatattttttaaagccagtcaaatggagcagtagggggttgtatactgacaccgagaaggggagtcttgggttgggtcttgaaatcaatgttagttctccttcaagacagggttacactaacataattttagattcttatcccaagtctgccttacttgattctaggtgactggagttgcagcttagtaggtgggctctagaaatgtgatcatttggccaaggttggaagasgtagtggagctgctgtgattattttgkcgttctttcttcgatatgatagcagatgagctgtaaagatgcttgtgtaatgtaacactttattatgcaatagccagtttaagaaattagagaattttagatgttagtaat

SEQ ID NO: 16614 - DNA, 523 bp, Homo sapiens
actaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgcggcggaccgtgaccgaggaaacccctggaggacttgggcattccttgggctccgtgcctgttcttcgtgctcctttcggtaaaggcaaggatctcacattatcagtctttgaccgacacagaatgcctggcatttgataaatgttgtgttgaacttgaagagacatatggacaatgaatctgcaaagctcaggcccagaatcagcagcagacagaaggtgtaaaaactgaagagagtgaacctcttccctcgtgccctgggtcactcctctccctgatgactcatgcstttagattgtaagaatccaatgcacattccagat

SEQ ID NO: 16615 - DNA, 493 bp, Homo sapiens
aagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggccacctcaggaccctgtgattggcgcctgcgcggcggaccgtgaccgaggaaacccctggaggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagacctcttcttttcttattccaaaatgttgagatactggggagagataccaatatcatcaagccagaccaacagaagttccttcg

SEQ ID NO: 16616 - DNA, 434 bp, Homo sapiens
caaagttgcctctttaaaaaacatgtattgttctagatttatattataatagcatgtgtgtatgtgtgtatatattccaatgcaacgtgtaagtaaacaaagatggcgtatcatagataatcagaacttgtggtagcactgaattattttattgggtatgcagaagctgtaagcaaataatatagttaaagggtagcttatacatttatacagtaaaataatgttctgaaactagaataagttagaaagtaagggaagggccaggcgcagtggctcacttctgtaatcccagcactttggtgggccgaggtgggcagattgcttgaggccgggagttcgagaccagcatggccaacatggcgaaaccccatctctactgaaaatacaaaaattagccaggcatggtggcatgtgcctgtggtcccagctactcc

SEQ ID NO: 16617 - DNA, 298 bp, Homo sapiens
aagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagag

SEQ ID NO: 16618 - DNA, 469 bp, Homo sapiens
aatctagaatgtcactgttcaagttaaagatggtcaagggaatcaaggctcatacttcataaattcttataagtcatttccctgtgttttgattcctcctaggaatcccacatacaccattaaatgtattggtaaagtccgaaaatcacactatttatctttccttaagatcttttcttgccttttcaacattccttctaaagttgaggctacagctacaggtcacgagaatggaatattggcatgagtatgtgccaatgtaaaacgatgaaatggtaaagcctgaaaccaagatggaaaaatctctgtattacttttttctaaaatctaaaaattatctttcacattactctttgctatgcagttaaacaaaaaaaactttgaactctgtgctttatttttatgtgacatcaacgtgctgcattattctgccttaatatttccttttttttttttttaaaamaaattc

SEQ ID NO: 16619 - DNA, 452 bp, Homo sapiens
cttgttctctctcccgctctcggaagctttcgtctcgtgggtgcgaaaggtaaccgaagcggctcaggaaggcagctgtcactgagcccctggaacagagcgagagtatcgtagtgggcagcagtcagtgacaggtgtaactctgtggatgacagcaacagttactggaggatacgggggaagagtgccacagtgtgttagaggggaaccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaaatggamcctactgggtgaragatggtgaggygcggttcaaacastcttccactgaggtactgctgtctgtcacaggagaaca

SEQ ID NO: 16620 - DNA, 529 bp, Homo sapiens
attttcttgttctctctcccgctctcggaagctttcgtctcgtgggtgcgaaaggtaaccgaagcggctcaggaaggcagctgtcactgagcccctggaacagagcgagagtatcgtagtgggcagcagtcagtgacaggtgtaactctgtggatgacagcaacagttactggaggatacgggggaagagtgccacagtgtgtgagaggggaaccccatcaagtgtggccagcccatccggctgacacatgtcaacactggccgaaacctccatagtcaccacttcacttcacctctttctggaaaccaggaagtgagtgcttttggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacatgttcacagacatctgttgctg

SEQ ID NO: 16621 - DNA, 491 bp, Homo sapiens
aaagaacagaggcaagcctccagccaggagctcatgaaatcatgaactgaggcctcagtgcaatagctcatgaggaaatgaattatttcaacagccagttctggaagttggaagtacaagatcagattgccagcatcatcaggtactcatgagggccgtcttccagcttgcagactgccaacttctcattgtgtcctcaggtgagtaaaaagtgatgacgctgcaaatgacaaccttaactagtctctccattgaaaagcctcataaatgtctaatagccacaattttacttggctacttcagatggactgaaattggaacttgaagacccttgtataagaaaaagaaccgttgtaaaccattgcaaatctcagccaagacaaaatggcctttaaacatttacaataaatgcactgaatatctgtggaatcacataactcaaaaataagaacagacatatttttctataactttgatatcattttgtaagc

SEQ ID NO: 16622 - DNA, 431 bp, Homo sapiens
atcacttgattattaagttagtatgtttaaggatgttgactgctgcctttctgggggagaatacagttgggatttataaaagcttgcttgaatgaaactgcctcttaagtgattgttaataatgaatggctccagttgacttctaatataccttctgcaattagcatggtggattttacaataggaaaaataggactattgagtattaatggtaacagatttttttaattttaatttttattttttgaagccctgtctctactgaaaatacaaaaattagcctagcatggtggcgtgtacctataatcccagctactcaggaggctgaggcaggagaattgcttgaacctgggaggcggaggttgcagtgagctgagatcgtgccaccgcactccagcctgggtgacagagcaagactgcatttcaaaaaa

SEQ ID NO: 16623 - DNA, 60 bp, Homo sapiens
agcgcaaagatgtccgcgcccgctgccgggagsgaggtgagtctttgatcgtaaccacca

SEQ ID NO: 16624 - DNA, 458 bp, Homo sapiens
  misc_feature 430: n=a, g, c or t
atgcattttgatgtgaaagatgttataataatttctagaagacaatttggtgtatcacaacatgcatgtctatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaanctatttgcattcttgtaaccttctatgg

SEQ ID NO: 16625 - DNA, 488 bp, Homo sapiens
acattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaggcacagcagtggtcctggtacagtatttaagtgtcggcatacacaggcgtaatccctgtataaagtagtgccaaactgatttcagttgtgtamtagtttaaaaccc

SEQ ID NO: 16626 - DNA, 473 bp, Homo sapiens
aaaaagaacagaggcaagcctccagccaggagctcatgaaatcatgaactgaggcctcagtgcaatagctcatgaggaaatgaattatttcaacagccagggttgctctgaagactaaagccctgggatcattcattttaaaagaaaagaacggtgactcatcatttcaagcttttcaaatatgaagtattacagtaaaaaggatttcactaaaaaaaatcatctaccatacagacactatagaaggcttggaaaagacattgtaatataaaagatatattttaaattgtgtctatccctggaactctattaaaattcaatattaagaaagtcacaaaggagtctaacttgcctttcaaattctggaagttggaagtacaagatcagattgccagcatcatcagaggaaaatttggctcgtggtgatagtcttggatatcaccttcatcccctcggatgtttgtagataatcc

SEQ ID NO: 16627 - DNA, 490 bp, Homo sapiens
attaaatcctgtgcttctgtggagggagagcgaaggaagagtgtggacagtgggggccaggaagttctcaggtagcccagcaggccacgcagaagtcaaggggtgtgtaggtacaggaggggccgtctccacagggagacgcctggatccatactccatccaggcttcatctgcagagaccaggggtggacacctcgtttgtgggggccgtcacagctgatgccccagctcaggatgtccaccagaaaccaggagtcaccatcctcttaagggtggtgcctgtcctccagagagcatatcactgggttcaaaccccagctcctaccggcaaagccggggcctccacctgggtgttcccatccatgaagcggggatacacagtgtggagcccttgggaggttggggagtgtgcctgccctcaccgcgcatcagctcataaatacaacaacagttgccttcacgtgctgatgctcagtgagcaggtggcgca

SEQ ID NO: 16628 - DNA, 334 bp, Homo sapiens
acaattccctgagctctcaactccaagttgtagatttggtgtcttccttgttcttactttaaaaagtcatgtgttaatttkkkkkttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaaataatcacagactatcatctaatctggttacatattgtatttttcatcctgaataaaagtaattttaacacaaaaaaaaaaaaaaaa

SEQ ID NO: 16629 - DNA, 325 bp, Homo sapiens
attcctgaagctgacagcattcgggccgagatgtctcgctccgtggccttagctgtgctcgcgctactctctctttctkggcctgrrggctatccagcgtgagtvtctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggawkggggaaaggggtgcgcacccgggacgcgcgctacttgcccctttcggcggggag

SEQ ID NO: 16630 - DNA, 381 bp, Homo sapiens
gtaggtaaagattccagcatcttggaagcaagtgctccactggaaaataaaagccacgtggagcacttgattagactccagaaacagaaactgcagctgctcccaccacccccaccaccacaggccctgccckrggcacagccaaccacacaagtgcaagtgcagccgtcacccgcctaccacagcagagcccccagctcaccacagtcacggccccgagacacagagccctgttgatgggcaccaccatggccaacctccagactcgagtttccacctcccacctgcaagcccaagactgacgtcagcgctgacgtaccagatggcccaggttgctgtggccasgccccctgtggtgtctgtcctggcagttgtggtgct

SEQ ID NO: 16631 - DNA, 340 bp, Homo sapiens
gtaggtaaagattccagcatcttggaagcaagtgctccactggaaaataaaagccacgtgtctttttaaaagcatgagtgaagaaagacataaacttccggatttgcgtaagtgagcttgccaactaaggaaacacatgagtattatctgtatcttcaggagcacttgattagactccagaaacagaaacygcagcygctcccaccacccccaccaccacaggccctgcccggggcacagccaaccacacaagtgcaagtgcagccgtcacccgcctaccacagcagagcccccagctcaccacagtcasggccccgagacccagagccctgttgatggg

SEQ ID NO: 16632 - DNA, 239 bp, Homo sapiens
tgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacaaaaaaaaaaaaaaaaaaaaaaaaaaaaaaaaaaaaaaaaaaaaaaaa

SEQ ID NO: 16633 - DNA, 433 bp, Homo sapiens
aagtcggcaagcccagattctagtggcaagttcacagactccatctcttggtgggggtgtggcaaagccacattacagaagagcaaatggaatggaaaatgtctgcgagaaagtgaccaattctgtatcctccgagctgcaaccttatttccagactctgscagtwatkgacccaaaatagattcygtgggccctggaatcamctatggyctggtggcacctccagcaaccacggctgagaccctggatgtacagatgaagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaac

SEQ ID NO: 16634 - DNA, 182 bp, Homo sapiens
aatcaggcgcgggctgagctctacgaggcggacggggcggtggcgacggcgatgggaccccagctagagatctgcagctaggctggctgcacttgctccacgggtcaggggatcggagggggattgaagaatgcgccattaaaaggaaagatcaaggagtaaaccaaaaaaaaaaaaaaaaa

SEQ ID NO: 16635 - DNA, 399 bp, Homo sapiens
attagacttaactagggttgtaatcttgccaagtgagtacgaacaattgatgagggcagaggaagttggggtaaaaggaaaggagtgattgtaataactgattatagaatttacattgggcaaggaaggcagacagacatcatggggatgaaggacagagaaaattagtagatcatcagactgtaggtcctcctgcagtggtttacagattctgggtgtagtgtagtataagagatcttgagtgagctggaaagtggaagggtgcatgaaatcaagattatggagggtttgtggtaattggtaatgacagagaccaggctagatctcatgagagtgagaggccaagatgaggagttcaaagaactgtgaggccaaggtgttggaaggatctttgaaggc

SEQ ID NO: 16636 - DNA, 460 bp, Homo sapiens
atttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgkcaataaacttatgacgttaaaaaaaaaaaaaaaa

SEQ ID NO: 16637 - DNA, 443 bp, Homo sapiens
aaacttaaggaagaagtctctcctgaagtcacgagctgcattgtctggggttcgggtagctgtgaasaagcactcccttggccactccagctggtgtctcactagccttgccagcgccttatgatttctgacttttgaagaatagctactctgactaagagatgagtaaaaggaaatccaaagtggaggtctcagtttcattggtgtgtttgttgcctacattcacatatgtttaatggcaaaccaagtctagacagaaggctttctcaagacagcagaaatttatttatcatgattttggaggccagaagcccaacatcaggatgccatatggtcaggtcttcatgaggactttcttcctggcttgcaggtgacaccttcatcctgtatcctcacatggcagagaagtacaatatcctcactgaatcaggtctttgagttct

SEQ ID NO: 16638 - DNA, 480 bp, Homo sapiens
tgtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgaaaatttcaaactcttaactttaactatggttggttcaaacacccctgcttgtttgttgtctcgaggtttacattgctca

SEQ ID NO: 16639 - DNA, 367 bp, Homo sapiens
attttagaaaatgtgaatctgcctgccattcttggaagtaacctctgtgactggaagatggaagaactgccccaggctcaggtgttgactttgaagaggggcttgagcagagagaatgcttagaggctaagcgatgggcaagtgagagggaaagagccgcgacagatagagctggctgcctaggggtctcagaggcttcatcctgcaggcggcaggcggcaggacaaagggaccttcggactccagatcaagattccaaggagttaaacgctaccacgcagcccgacctggatgggatttgctcctgggtacaaaacgggacactgatcaaaatcaacttggacaagtgacaaaaaaaaaaaaaaaa

SEQ ID NO: 16640 - DNA, 392 bp, Homo sapiens
tgtgtaactgttgaatctggaaattgatcagcattaaagggcacatgaagcagtgtctgcaggcgttcagtgctgcggasctgttaaaggtcactcagatgtgcaggtgttaatcttctctaaaagcctggtgatacagctctggctttctgagcacactacggatctggaaaatactaggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagcmasttggcagaaagggtgcagggctgctggtgtcagagcaaga

SEQ ID NO: 16641 - DNA, 482 bp, Homo sapiens
aaaaagatcctggtcccttggattctgaagcggaaggagagctgtctcctccagctggtggaaactgcttcctatcctcctcctggagagcccaactcccagagcagatggcagaggagacctttagatggggcggtcacatgtcccagctggccttataacaactgtcccagggaactattaatagatctaccttacacacatctggactttcagatctgaaacgccctggtttggatgacagattatatggtgaacctacttttagagtgtagttcaactcatttgtcacatggatgagaaaatcagtccataaagggtttgctggggccaacaccagcctaagtggagagtaagcgtccattctcctagaccggcacttaaagcctggctgtcacccagccatcccgtctctgtgctggatkgacaccaaaccccaaggccctcatctgcctttgtcccaactactrtccagtgcttca

SEQ ID NO: 16642 - DNA, 464 bp, Homo sapiens
ataaaaaaaataagccaagtatagaaggacaaatactgcatgatgtcatttgaatgtggaatctaggagctgaactcacagaagcagagagtacgatggtggctaggggtaaggggtcaggagtacagactgaagagatgttggtcaaaagatacaaaatttcagttagatgtgaagaataagttcaagagatctattgtacaacatagtgactatagttaataacaatgtattataatcctgaaaattgcccagagtagattttaagtattttcaccacaaaaatgataaatatgtgaggttatacatatgttaattagcttgagttagtcatttcacaatgtatacatattttataatgtcgtatatgataaatatatacaatttttatttatcaatttaaaaaagaaaaaatattctgtctttttaaaccataattaatcagcttctctttcttctgagat

SEQ ID NO: 16643 - DNA, 135 bp, Homo sapiens
aacccactaggggatgagcccgaactagggatgtgacagagcgcgagacccagcctaaagagagcccggagccagcgtgggaggccgctgccgtcgcgcgccttggtttttctgttccttttttttttttttttt

SEQ ID NO: 16644 - DNA, 348 bp, Homo sapiens
  misc_feature 237: n=a, g, c or t
atgagatgtaaaagtgggtgggagagggcgtggcaggagagccagggaatggattgagagtgggttcccagtggaggggtgcatatgcagagtcctaaatgtgatcaggagcgggagagtaggggtaggagaggaaaagagtcaccaatgatgaaacgggagaggaaagtggcaattttagatgaattaaatgcttttcaccagagaacaaccccctttgactgtaattgtccactncccacccaaatcctataaaacagccccacccctgtctcccttcactgactcctttttcagactcagcctgcctgcacccaggtgaaataaacagccttgttgctcacaaaa

SEQ ID NO: 16645 - DNA, 414 bp, Homo sapiens
gctatgtagcaagaaatgagatggtagagactgagtatagatggttccttgcagaatcgcttatgactggaaggggcacacagtgggggaagaagcagaataaagagtagtttgtagtattttcatttttaggctgcaasttgagcatgtttagaagctaaaaggaagagctaggtgaaagggggaaactgaggtgtggagagaagcagattcaatacccaatagagccaggtctgcagtagatgggaagatgggtctggagaagaggggacaggacgaaccaaggaccagaggggtgtggaagcctcaagacaagaggaatcacagagaagacagatgcacaatattcacacctgtgtatgctccgggagttgctttgcttctcgtgcagtttgttaaattaggtgaatttca

SEQ ID NO: 16646 - DNA, 488 bp, Homo sapiens
ctttatgatgtgatctctccttaccttcttagtgcatcttccattaccttcctttcccaaccccttactttgtactccacccattctaaaatcactcgagaatcggtcttgtacttttttttcctctggattcctacccagatatggtgtttctaccgggaataatttccctcaactcttccactgaactgacttttggtcaacctttagcacttagctatcatcttctctgggaagcctgtgacttctccagtctggactggatttctgaagcactttgatcataactctgagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggattgaatttgttaaacattttcgta

SEQ ID NO: 16647 - DNA, 373 bp, Homo sapiens
atataaaagtctcctggggtggagacaaagaagtcattgtattcaaagaagaataagcaagaaagaaaagaaggaaggaagagaggtagacagatacaagatgaaatcctgtcaaaaaatggaaggraaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgt

SEQ ID NO: 16648 - DNA, 466 bp, Homo sapiens
agtttaagaaacagtcagtggccaacggtgtggagatatctgtgcctgtacccagcgatgccgactcccccagattcaagaccagtgtgggcagcgcaagtatgtgccggagagaaacgtcgtgatttggagtattaagtctttcccggggggcaaggagtacttgatgcgagcccactttggcctccccagtgtggaaaaggaagaggtggagggccggccccccatcgggtcaagtttgagatcccctacttcaccgtctctgggatccaggtccgatacatgaagatcattgagaaaagtggttaccaggccctgcctgggttcgctacatcacccagagtggcgattaccaacttcgtaccagctagaagggagaagagatgggggcttgaacacggggcttccttacagcccggatgcagattttagagggagggcaggtgcgggctgtgtgtgtctgtgt

SEQ ID NO: 16649 - DNA, 359 bp, Homo sapiens
  misc_feature 222: n=a, g, c or t
wtgragatgtaaaagtgggtgggagagggcgtggcaggagagccagggaatggattgagagtgggttcccagtggaggggtgcatatgcagagtcctaaatgtgatcaggagcgggagagtaggggtaggagaggaaaagagtcaccaatgatgaaacgggagaggaaagtggcaattttagatgaattaaatgcttttcaccagagaacaaccccctttgnctgtaattgtccactacccacccaaatcctataaaacagccccacccctgtctcccttcactgactcctttttcagactcagcctgcctgcacccaggtgaaataaacagccttgttgctcacaaaaaaaaaaaarr

SEQ ID NO: 16650 - DNA, 381 bp, Homo sapiens
atgagatgtaaaagtgggtgggagagggcgtggcaggagagccagggaatggattgagagtgggttcccagtggaggggtgcatatgcagagtcctaaatgtgatcaggagcgggagagtaggggtaggagaggaaaagagtcaccaatgatgaaacgggagaggraagtggcaattttagatgaattaaatgcttttcaccagagaacaaccccctttgactgtaattgtccactacccacccaaatcctataaaacagccccacccctgtctcccttcactgactcctttttcagactcagcctgcctgcacccaggtgaaataaacagccttgttgctcacaaaaaaaaaaaaaaaaaaaagaaaaaaaaaaaaaaaw

SEQ ID NO: 16651 - DNA, 516 bp, Homo sapiens
accgcrcgggaggggcggggcctgccgccgcaaccgcctcagggaagaggaaggaggccgcggcttcgcgtcccgcctctcgcctggctggccgtkkgrggcctggacgcatggcctcccgaatctcccaggaccctaatatcgcccgaggatgctgggaggaacgctgagccgacctctccgttaggctgaagattgcacaaaccatgctaatggccagcatggatggagggagcgtgtgagatgtttggggcagcgtgctgcatctcagccaactccaggagccagttgatgtgatggactaccttaattgatttttgaatgttgagccagccttatgcatgtgggataaacccctgttgatcatggtatgtatttcattttatacagtgtcagctttagtttgctggatttttaaaatatgaaatctcttttataatttcatcaggatattggaataaaaaagatgtagatgcatatattcagtcattccttttgaaccagttatatttctaa

SEQ ID NO: 16652 - DNA, 436 bp, Homo sapiens
aaaaacttgggacgactgcaaatcaacatgaatacctgttgaatgttagaacagaaggtctgaccatggactcaagagctgacgttaggaatgtcagcaccatcctgctctccaaggactcctcatcttcaacagactcctcatcttcaaaggaaagggtggaaactgcaacttgtgccatgatccctgcgtgagaaaagtagtaagaaatcctacccgaccatagaatgttagaacakraggtctcaccgtggactcaagagctgacatgaagaatgtcaccaccatcctgctctccaaggactcctcatcttcaatggactcctcatcttcaacggactcctcatctacaacgggcakggtggaaactgcaacttgtgccatgatccctgcgcaagaaaagtagtaagaaattgagtggtagaaatccagtgtc

SEQ ID NO: 16653 - DNA, 518 bp, Homo sapiens
actttctgaagctgagagggagccggaaaggaagggactcaggggatctaatgggagccagaagggcccagacttaggatccgaaattgtgcctatgagagtgagtcagtgtcttggtctgtcacccgggctggagtgcagtggtgcaatcgtggctcgctgcagcctcgaccttcytaggtttaagtgatcctcctgcctcagcctcctgagcagctttggactacagtcctgtgcaagatcctcttgttggcaaactctaacctgggagcatgaggaagaggactgcggggaacggtttccagccctacgtagacatggtggtggtgacgtgttgacacatgggggctccgcttcggacttcgcaatgaataaggccagggaactgcagctgatggctgggtcatccgagagaccttcaatctttactttctataatgacagagcaaaccattctatttgctatttactttcctgatgtatcttcaagaaacttctggaaataggtctttgtgtcc

SEQ ID NO: 16654 - DNA, 375 bp, Homo sapiens
ttaacagaattgctgcttccacctccttgtaatgaggtggggtaggaaagccttcagaaaccattctcactgtctgctgtcctgatggtgagccactctctcgtgaattttgcaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggtcagtgtgacatggtcatcagcgtcatagctggctcttactgagtgacagagcgagactctgtaaaaaaaaaaaaaaaa

SEQ ID NO: 16655 - DNA, 367 bp, Homo sapiens
acaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagaggstgctgggactggcgtctgtacacacttgtttggccttttctgtagttgatgctgtaaactctatggctttttaaaaacgatttcatgtttttatttagtattggaaatccaatacacttttttaatccaaaaaaaaaaaaaaaaa

SEQ ID NO: 16656 - DNA, 430 bp, Homo sapiens
gagatctacgtgccagtcagcctgggcttctgccmmcmmmrsccywmcsggrrscsgramccyyykkkgscsramccccytycyksccssykgsyttkrammwkrrscytysrrrmyyywrsywmmrsmwkgsccccsggscykkkkkgkkgsccmrsywmccyyykrarrmmwkggscmmytkrmmrrmccccmrrrsmrrrrmcmwkgsytycyksssmmcmarrwkrargkkrmccytkgggrmmrkyccmrkkgrracctgttcacctgccgtgtctgccagaaggccttcacctaccagcgcatgykramcsscmmmwkrarkkkymmmamsrmskymarrrgsmmcyyyksmmskwmykssggragggcttcaatgacaccttcgacctcaagagacacgtccgaactcacactggcgtgcggc

SEQ ID NO: 16657 - DNA, 914 bp, Homo sapiens
aaaaggagtagctattagccaattcggcagggcccgctttttagaagcttgatttcctttgaagatgaaagactagcggaagctctgcctctttccccagtggcgagggaactcggggcgattggctgggaactgtatccacccaaatgtcaccgatttcttcctatgcaggaaatgagcagacccatcaataagaaatttctcagcctggccgaaaatggttggccccacaagccacgacaactggaggcaaagagggttgctcaacgccccgcctcattggaaaaccaaatcagatctgggacctatatagcgtggcgaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcggaaagcggcccccagaaccgaccacaccgtgcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaastgagaggcttgtgaaataccgagaggccaatggcttcccatcatggaatccaactgcttcgaccccagcaagatccagctgccagaggatgagtgaccagttgctaagt

SEQ ID NO: 16658 - DNA, 121 bp, Homo sapiens
agcaccatctgtcatggcggctgggctgtttggtttgagcgctcgccgtcttttggcggcagcggcgacgcgagggctcccggccgcccgcgtccgctgggaatctagcttcttcccccvg

SEQ ID NO: 16659 - DNA, 457 bp, Homo sapiens
atatatatcttctgattcaaccaagtgaaaatgtggcttcagaggaggtgacaaagtgtgaccatacccaaaggctgtcaaggtaatgttggaagcgagtgtatgtatatgggtagcagtaagcaaactgccaagttctgcaacttgactctgagagcctgctgtctccactgaatttgattatgtgctatcaggagaatccatctactgcctgcagctgtcgagctcctctcctgggtgagccgggatgcctaacctgattagcagacaaagtagagctaatgggctctagggcaatcattcagggaaactgagatgctgttcagggcttagattttctagactttcccaaggatacaaacagaaatctatttgaggagggctcagcaggcaaaattcaagactttcaagtaatgcaaagaataaagcaaagggggctgaaactaaaaaaaaaaaa

SEQ ID NO: 16660 - DNA, 463 bp, Homo sapiens
  misc_feature 447: n=a, g, c or t
tgtatagcttcttgcttggccacactccctggtgagctggctggttctctacctgggggttggtgggggcacgcagagggccagagckccctccccgctccgccctccgccctccaccctcacctgtgtttgacttgctgcttagctgctccttgggatctgataaactgaacttggaccgtggtaaagtcagcctgggcttctgccaccacagccctaccgggagccggaaccctctgtggccgaacccccttcctgcccgctggctttgaacatgagccttcgagactctagctacagcatggcccccgggcctgtgtggtggcccagctgccctctgaagacatgggccacttgacagacccccagagcagagaccatggcttcctgcgcaccaagatgaaggtgacccttkgggacagtcccagtggagacctgttcacctgncgtgtctgccagaagg

SEQ ID NO: 16661 - DNA, 475 bp, Homo sapiens
aatcgcagccatggcgtcgttactgtggggaggcgacgcaggggcggcggagagcgagcggctgaacagcacttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttgg

SEQ ID NO: 16662 - DNA, 452 bp, Homo sapiens
agtcctttcccttccctatctctcccctctccttccttcccctcctcttctctctctaatcttcattattctttcttatcctcaaactcatcttccggtatcatgttttcctcaattcttgctgatcctgtttttaattctttgttccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtggactcaactataaatcttgcttccagccactgtttcagttcgaggacatgcaggaaatcattcagaactttgtgcgggttcatgtggatgcccctggaatggaa

SEQ ID NO: 16663 - DNA, 475 bp, Homo sapiens
aaaaaaggcaagtgaaggtggaagcggccgcggcggcagcagaccccagagtcagaaggagtgagaaccctgacccctaatcccactgcatccagccaataggagcccagccaccatggcggastgcaggaggtgcagatcacagaggagaagccactgttgccaggacagacgcctgaggsgccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatccttgcgtcctgcagtaccta

SEQ ID NO: 16664 - DNA, 285 bp, Homo sapiens
aagtgaaggtggaagcggccgcggcggcagcagaccccagagtcagaaggagtgagaaccctgacccctaatcccactgcatccagccaataggagcccagccaccatggcggastgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcaccccaaacccm

SEQ ID NO: 16665 - DNA, 504 bp, Homo sapiens
aggaaaggaacaagggaaagagccggtgaaggggcagaacaggcaggttccctcgacccaggaccccctgttcccaggctatggcccccagtgccttktagacctggcaggccccccgtgcttgcgacccctatttgggggtctgggtggctactggagggccttgcagaggggcagagaaggcaggaccatgacatctagggcctctgaactttctccggggcgcacgtgacggctggcatcatcattgttggagatgagatccttaagggacacactcaggacaccaacaccttctttctgtgccggacactgcgctccctaggggtccaggtttgccgagtctcagttgtacctgatgaggtagccaccatttgcagctgaggtcacttctttctccaaccgcttcacccatgtcctcacagcagggggcatcggccccactcatgatgatgtgacctttgaggcagtggcacaggcctttggagatgagctgaagcacac

SEQ ID NO: 16666 - DNA, 488 bp, Homo sapiens
gaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctctcccattgtcttttctggcttctccag

SEQ ID NO: 16667 - DNA, 528 bp, Homo sapiens
tccatttttttccatttattcagcaatacttactaagctattttattgtatcccaggggctggctggactctgtggggaatacaaaaggaccagaaatagtccctgcccacagtgaacttaaaatttgcttacggaagagcagctttatacacagataaccttgaactagggttgaaagtgatgaaagttttgagagtgctgtgaactttgcacagaaagagagagtttaagttcagcattgggagttagggaaggcctgagctggaaatgaaaaatggtttaggaaacagacctgtgtccgggtgcagtggcttacgcctgtaatccaagcactttgggaggccgggtcaggtggatcatttgaggccaggagtttgagaccagcctgggcagcatggcaaaaacccatctctactaaggatacaaaaattagccaggcatggtgccacacacctgtagtcccagctactctgggaarctgaggcactagaatctcttgagcccatgaaggtcgaggctgcagtgag

SEQ ID NO: 16668 - DNA, 472 bp, Homo sapiens
caatatcagctaggacaacatagcaagatcccatctcaacaaaagaaaaattaaaaaaaattagccaggggtggtggcacacacctgtagtcccagctcctcgggcagctgaggcaggaggatcacttgagcccaggaggtcaaggctacagtgagccatgatcacaccactgcactccagcctgggtgacagagcaaaatcctgtctcaaacaacaacaacaacaaaatgtagctgtgggagatgcagagctcctggcatatgaaccagcatgctccaaggccctgaagcaggtatgagtgagtcacttttaaggaactgagaaaacttgtgtgactttacctgtcacttaactgatcagtgactctcatttgggaccctaataacttgtcttccagagggtaagggcatggtccttactgccctaagtgccatgaatctgtttataaaagtcacccaggctgggctcggt

SEQ ID NO: 16669 - DNA, 435 bp, Homo sapiens
caatatcagctaggacaacatagcaagatcccatctcaacaaaagaaaaattaaaaaaaattagccaggggtggtggcacacacctgtagtcccagctcctcgggcagctgaggcaggaggatcacttgagcccaggaggtcaaggctacagtgagccatgatcacaccactgcactccagcctgggtgacagagcaaaatcctgtctcaaacaacaacaacaacaaaatgtagctgtgggagatgcagagctcctggcatatgaaccagcatgctccaaggccctgaagcaggtatgagtgagtcacttttaaggaactgagaaaacttgtgtgactttacctgtcacttaactgatcagtgactctcatttgggaccctaataacttgtcttccagagggtaagggcatggtccttactgccctaagtgccat

SEQ ID NO: 16670 - DNA, 550 bp, Homo sapiens
accatcgcgctgggggttagggcttcaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaagatgtgaatcatgttttttgtttcttgatctctgcggttttttcaagtacgcgtattcattttgtgaaaattcaatgagctctacactttatatgtagctgaaatacaacatcataatttttactggaaaatagccacaatgaaggaacaccacaatttcaccatgaaaaccagcacaaccttacacagatkacaaacatttcccctcaaaacttgttaaactgtatttgggctgaccaaattaaccagagttattctatttatgggggagcaggaagtaacttgataaaatgctttgagtttatatatcatgtca

SEQ ID NO: 16671 - DNA, 519 bp, Homo sapiens
ctgaaarattccatctgtaaataccatcgcgctgggggttagggcttcaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaaggtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaagkaaaaaaaaaaaaaaatg

SEQ ID NO: 16672 - DNA, 479 bp, Homo sapiens
aaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaaggtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaaggaaaaaaaaaaaaaawtkcgaaasc

SEQ ID NO: 16673 - DNA, 529 bp, Homo sapiens
aawtamytyctgaaarattccatctgtaaataccatcgcgctgggggttagggcttcaacatatgaatattgcggggacacagacattcaatccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaaggtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaagtaaaaaaaaaaaaaaatgs

SEQ ID NO: 16674 - DNA, 527 bp, Homo sapiens
cgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatctaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgt

SEQ ID NO: 16675 - DNA, 395 bp, Homo sapiens
  misc_feature 332: n=a, g, c or t
ctccaggctttgtcatggcggctgctgctgcacgctggaaccatgtgtgggtcggcaccgagactgggatcttgaaaggggtaaatcttcagcgaaaacaggcggcgaacttcacggccggagacagccgcggcgcgaggaggcagtgagcgccctgtgttggggcaccggcggcgagacccagatgctggtgggctgcgcggacaggacggtgaagcacttcagcaccaaggatggcatattccagggtcagagacactgcccggkbyggggagggcatgttccgtggcctcgccaggccgacggcaccctcatcacatgtgtggattctnggattctcagagtctggcatgacaaggacaaggacacatcctctgacccactcctggaactga

SEQ ID NO: 16676 - DNA, 609 bp, Homo sapiens
  misc_feature 569..570,573..574: n=a, g, c or t
agtttgggaaacgtttttcctacaatttttgggggcaattataacaattcttcacaggagttagaatgtaagtacaattatttctttttaatgtggttaaaggaaaagcatatttaaagattatataatgaaaatgaatttttaatttttgaatgcaattgtaaacgagatataaaagttattattttattattagtcaaaaatgctgtgatctttggtaacataattttatagacctttttatgactaccttcttaaaactttaccttgtacagcaagtatgctacctaaccactcactctctgtgtcattttagatatggttcgtatattttcagcacaaatttctcttaaatcccatgtacctcaagcgactgcatttcgtttttttgtaaacatttaggttcaggggtacatgtgcaggtttgtcacataggtaaaattcatgtaacggggatttgttgtaaagattatttcatcctccaggtaataacgctggtacccaagttattttttctggttctcttcctcctcccaccctccaccctcaaataggtcacagtgtttganncwnnccttctttgcgtccaagagttcttatcatttagct

SEQ ID NO: 16677 - DNA, 387 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaaactttcagagtggaaggatggttgtc

SEQ ID NO: 16678 - DNA, 394 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaaactttcagagtggaaggatggttgtcccaaaga

SEQ ID NO: 16679 - DNA, 216 bp, Homo sapiens
atatactcgagcacaaaagactttatatggagcaggaagagggaggcccacccgcagaagggagctacccactgtgagtctcttctccactgagagctggacactcattaggacgacctgcctttggaaagaactacccactttgggtctcccgagaactgttctgtcactcaataaatctctccaccttgttcatccgaaaaaaaaaaaaaaaaa

SEQ ID NO: 16680 - DNA, 374 bp, Homo sapiens
cttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaacttatgacgtcaaaaaaaaaaaaaaaaagg

SEQ ID NO: 16681 - DNA, 531 bp, Homo sapiens
agatgtgggctctgtagataaggactggcaggaaagttgtttactgaaactaaaacagggaggcacaaaggataaggaagttagtttggctttggaagtagggaacaaagaacaaggacactgaacaagctaaatctttgaagaggaacttcttttgtatctgacaaaggtcttcaaggaagaagggagagagtgacctttctaggttttatggttgatgctggtggagaggagttctagtttctaagatttaccttgaggaagaagaactgtagtttctgtggcttgcagacaagcaaagcaaagctgataagcatcattagcatccattttaaatttaagcaaactgaactccaagaggttaagaaacttgctccaagtgacacagctggcccacccgcagaagggagctacccactgtgagtctcttctccactgagagctggacactcattaggacgacctgcctttggaaagaactacccactttgggtctcccgagaactgttctgtcactcataaatctctcca

SEQ ID NO: 16682 - DNA, 571 bp, Homo sapiens
  misc_feature 550: n=a, g, c or t
taaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacaggtattgatcagtcctgtcaattgggtttagtggttaggggtagcgtaatacgctgtaaggttcctgcagaggattcagggtttaatcactgtctagctgtcactttctagctacaggacctcacaagtcagtttgctgctctgtagttgcttatccctaataaaatggatgtaatatctcctcctgctctgtgagaattaagatctaatggattgaaaagactttgtatactatggagagatttttattggtggtaatggagcatgcttttantctcatattctatgtcagtat

SEQ ID NO: 16683 - DNA, 100 bp, Homo sapiens
aactaccaattaacgagcgaggaaacagggccagagaattggaacaaaatacaaggctgcctctgaaaggtcatgttcaagctaaaaaaaaaaaaaaaaa

SEQ ID NO: 16684 - DNA, 361 bp, Homo sapiens
aactaccaattaacgagcgaggaaacagggccagagaattggaacaaaatacaaggctgcctctgaaaggtcatgttcaagctaatttattggttattttgctctacccaaacccaattattctgattgatttccacccatataaatctactgtaaccagttcagacttctgtatgaagaatatccagaaaagtagaattttatattttggagaaattttcaggattagttttttttttttttaaaayccttttgctcactcagtgasatttttcagttattatctttgtatttatgtaaacatttgggcggcagtacatgtaattaaaggtgtgagttctagcaaaaaaaaaaaaaattg

SEQ ID NO: 16685 - DNA, 112 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaa

SEQ ID NO: 16686 - DNA, 146 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaaar

SEQ ID NO: 16687 - DNA, 107 bp, Homo sapiens
aactaccaattaacgagcgaggaaacagggccagagaattggaacaaaatacaaggctgcctctgaaaggtcatgttcaagctaaaaaaaaaaaaaaaaaaaaaaaa

SEQ ID NO: 16688 - DNA, 145 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaav

SEQ ID NO: 16689 - DNA, 120 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaa

SEQ ID NO: 16690 - DNA, 118 bp, Homo sapiens
aactasccaattaacgagcgaggaaacagggccagagaattggaacaaaatacaaggctgcctctgaaaggtcatgttcaagctaaaaaaaaaaaaaaaaaaaaaaaaaaaaaaaaaw

SEQ ID NO: 16691 - DNA, 145 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaaa

SEQ ID NO: 16692 - DNA, 164 bp, Homo sapiens
aactaccaattaacgagcgaggaaacagggccagagaattggaacaaaatacaaggctgcctctgaaaggtcatgttcaagcttaaaaaaaaaaaaahkgtawaaaaaaayaaaaarraaaaaaaaaaaaaaaaaaaaaaaaaaaaaaaaaaaaaaaaaaaaaw

SEQ ID NO: 16693 - DNA, 108 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaa

SEQ ID NO: 16694 - DNA, 111 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaar

SEQ ID NO: 16695 - DNA, 146 bp, Homo sapiens
aactaccaattaacgagcgaggaaacagggccagagaattggaacaaaatacaaggctgcctctgaaaggtcatgttcaagctaaaaaaaaaaaaaaaaaaaaaaaaaaaaaaaaaaaaaaaaaaaaaaaaaaaaaaaaaaaaaaa

SEQ ID NO: 16696 - DNA, 127 bp, Homo sapiens
aactaccaattaacgagcgaggaaacagggccagagaattggaacaaaatacaaggctgcctctgaaaggtcatgttcaaggctaaaaaaaaaaaaaaaaaaaaaaaaaaaaaaaaaaaaaaaaaaa

SEQ ID NO: 16697 - DNA, 394 bp, Homo sapiens
ctttcccgattctgactcccagcctccctccctcgcgcgcgctccttccaggtccgtgtccttaccgcccagcaccaggcccatcccgcagtgggcgacagtcgcggcctctctttaggtccagttggcaacgctggaggacagaagaagccaccggcgtgagaaccggctccccggagagcttcctagaccctccttcgcgtcagggtccgccagacccaggacccgctgccaccagcttccccggagcctgccttcctcctcctcctccttttcccgatgatcctagtcgggttcctgttacgtttgcaaggtgcattttgaaaagggaaggaaaatgtgcctttcgtatatcaaaatacagccttagagagccaaaaaaaaaaaaaaaaag

SEQ ID NO: 16698 - DNA, 472 bp, Homo sapiens
ggaaaacaagcgtgtttgagaaaagagagtgacttctttcacttaaagcagccattctcaaaggttgtggcctcaggatcattatacacttggcagttattgagggctcttgagagatttttattatgtaggttttatcaatgctcaccattattaaaaattacataaattttaaggccaggtgcagtggcttacggctgtaatcccagcactttgggaggcccagacaggcagatctcctgaggtcaggagttcgagaccactccggccaacgtggtgagacctccgtctctactaaaaatacaaaaattagccgggcgtggtggtggctgcctgtaatcccaggtactcaggcgactgaggtaggagaatcacttgagcccaggaggcggaggttgcggtaagccaagatcgcgccacggcactccagcctakgcaacagagcaagactccatcttaaaaaaaaaaaaaa

SEQ ID NO: 16699 - DNA, 498 bp, Homo sapiens
  misc_feature 395,424,431: n=a, g, c or t
ttaagtagtttaagtatgttaaatgtggatcttttacaccacatcacagtgaacacactggggagacgtgcttttttggaactcaaaggtgctagctccctgattcaaagaaatatttctcatgyttgttcattctagkttatattttcatttaaaatcctttaggttaagtttaagctttttaaaagttagttttgagaattgagacacaatactaatactgtaggaattggtgaggccttgacttaaaactttctttgtactgtgatttccttttkggtgtattttgctaagtgaaacttgttaaattttgtgtgttaactaaatttttttcttaaaataaagactttttcacaatgactggcacagattactcagcaaaagatagcaraacngggtggttgaagataattcattttaatcngtaatgnattttagtgtgaatttaaaaatttcatacatcaaatctatgatctcccttatattcttatgatgagg

SEQ ID NO: 16700 - DNA, 513 bp, Homo sapiens
ccttgtcctggacgccccttggcggtccgcactggcgggtgccctctcccgaggggaactgaggcggggcgcctgccaccattcgtgattttccgtgactcaccctctcaacagtgtcccgtcagcccccgctttctggaattaagatgattttccatgggcattatagtcagaggaggttttctgtgagacatctgggaaaggtgactcaatgatcactcatattgttctatgatgttatacatttaaccggaatactggtgaacagcttttatatcttggaattttttcccatttttgaatcagaaatttaggaccaagaatcttctgtcacagaacctattactttgaggagtgaacttatattaacggtgctaaaccgtacatgaacgacttggtagatgaaaactttggaaaataggaacatttcatgtcatcacatgtatcctccagcattggggaaaattcaacagttgccttaaggcgggagtttaattgaggcatttactaaaa

SEQ ID NO: 16701 - DNA, 155 bp, Homo sapiens
gcgttcccgactcggagcccccagctccgcgcgagcagctaaccgggctggctctcggtgtgtgcccttcggatggtcggctgaagagggccgccagctggtaagacactccgaggcaacgaccggtctccctctccctagcccggtgtgcagtc

SEQ ID NO: 16702 - DNA, 498 bp, Homo sapiens
ataaggaaaatgtctcctgatatagagctagggttacttgaaacagacatagcagagactgccaggcaccttttgggtttagaattagtaaggaaaactttggaagccacaagtttatcagcatcagcttaaagtcgtctatcttccaagcaagtaacagagtatttttgagtttctgaagataattgtctgtttacatgaaacaaacaaaaatacatcacacctattgagtcactcgctgagatgatccattgctataaactgaattgtgtccccccacaaattcatatgttgaagttgtaaccctcaatgtgactgcacttggagataagacctttagaaggtattggaggaaattctatatgaagacacagcaggaaagaagctgcctacaagctagaaagagatccctcatccagaattgaatcagccagcatcttgatcttggatttgtaatctccagaactgtgaaaaaataaatgtatatggtttaagcaa

SEQ ID NO: 16703 - DNA, 241 bp, Homo sapiens
catagcaacctactagataagggaagcttgtccagcctgcagcccaggacggctttgaatgtggcccaacacaaattcgtaaacttaaattttatttttgagatttttttttttaagctcatcactrtcattagtatattttatgtgtggcccaagacaattcttccaacgtggcccagggaagccaaaagattggacacccctaagataagagatatctttctatagaaagttattctat

SEQ ID NO: 16704 - DNA, 481 bp, Homo sapiens
  misc_feature 473: n=a, g, c or t
agtgagatcccgatcaagctttatcatgcagcccagaagggtgggggaaagaaaaagaattaggagaaaatgttgcaaaagtaatgagataatatgagaatgtgctttgggaactgcgaatctggagtcactggtccatgaggaatctaggataagaagaaggaagctgtgaagaatggttggctaacagtgctggcaaggaattcagatcaacatacctctcaaaagaatggaagtctcttaaactcaggatttggattgccatgggaacttttcagaatggactttcacaaaagctttgctctgagagcatggaagttggctacaacgttgcctgggaacaatacaaaggaggatggttttgaatgtcagtaacttttctgaatatccagcctacaaaataaaactttttctttaattgtaaagtaacaaaagacctctgtaaatatttgaaaaagaatagagacaattanaccatacc

SEQ ID NO: 16705 - DNA, 366 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcgggttcgaccacttggccgatgggaatggtctgtcacaatctgctccttttttttgtccgccacacgtaactgagatgctcctttaataccgtttgtg

SEQ ID NO: 16706 - DNA, 408 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagttaaaaaaaaaaargaaaaaaaaaaaaaaaa

SEQ ID NO: 16707 - DNA, 418 bp, Homo sapiens
agaacgtcctataaaggctctccccgaagcacgtgactcctctccgccagaccgccgccgcgccgccatcatggacaccagccgtgtgcagcctatcaagctggccagggtcaccaaggtcctgggcaggaccggkttctcagggacagtgcacgcaggtsrcgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaaaaa

SEQ ID NO: 16708 - DNA, 378 bp, Homo sapiens
ctctccgccagaccgccgccgcgccgccatcatggacaccagccgtgtgcagcctatcaagctggccagggtcaccaaggtcctgggcaggacgttctcagggacagtgcacgcaggtscgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaaaaaaaa

SEQ ID NO: 16709 - DNA, 484 bp, Homo sapiens
gtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaastagccaaggaaggaagacttcaagaagtcattgaaacccttctctctctggaaaagcagactcgtactgcttccgatattatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaagcaagatttatgttgaaattgagcgtgc

SEQ ID NO: 16710 - DNA, 413 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataccgtttgtgtttcaagttaaaaaaaaaaaaaaaaaaaaaaaaaaaaaaaammcm

SEQ ID NO: 16711 - DNA, 430 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataccgtttgtgtttcaagttaaaaaaaaaaaaaaaaaaaaaaaaaaaaaaaamccmaaaaaaaaaaaaaaaav

SEQ ID NO: 16712 - DNA, 425 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtggcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaavaaaaaaaar

SEQ ID NO: 16713 - DNA, 368 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcaksccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataccgtttgt

SEQ ID NO: 16714 - DNA, 407 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtsgcgtggaattcatggacgacacgagccgatccatcatccgcaatgtaaaaggccccgtgcgcgagggcgacgtgctcacccttttggagtcagagcgagaagcccggagttgcgctgagcttggctgctcgctgggtcttggatgtcggkttcgaccacttggccgatgggaatggtctgtcacagtctgctccttttttttgtccgccacacgtaactgagatgctcctttaaataaagcgtttgtgtttcaagttaaaaaaaaaaaaaaaaaaaaaaaaaaaar

SEQ ID NO: 16715 - DNA, 443 bp, Homo sapiens
ctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgtttgacacaaaacaggttctggttcaggtaaagttgcgtcagtcacctgcagcagaaatccctcttcattcctcttctctgtgttcattcctcttctgtgctgttctg

SEQ ID NO: 16716 - DNA, 496 bp, Homo sapiens
ggccgaagcagggggacagcaagggacgctcaggcggggaccatggcggacggcggctcggagcgggctgacgggcgcatcgtcaagatggaggtggactacagcgccacggtggatcagcgccttcccgagtgtgcgaastagcccaaggcatgcctttataggtattgatttaaatcttacaccaaccctgtggattggtacaattattgtgcccacttcgctgaagagaaaattgagagtcagagagcttgtgttttactcaaggaaggaagacttcaagaagtcattgaaacccttcactctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatgggttcaacagtgctgtacttatgtt

SEQ ID NO: 16717 - DNA, 176 bp, Homo sapiens
  misc_feature 165: n=a, g, c or t
aaatgagtgttgtttgtaaaacagtaacatcaaattggctagagagataaatgtatcatgttttaaattaggttttgtgagtagacagattacaattctattttaaatataaagtttataaaataaatactttttgtatccgaaaaaaaaaaaaaaaaaggcccnccytggccaac

SEQ ID NO: 16718 - DNA, 527 bp, Homo sapiens
agaaggatgcaccctgaggcagggaggaatgataaaataaaacagtagtagcaattcccaaggtgtggcaagctaaatattggcatttttgtgaagagtaaagtgcctttgtatgatgaatgggtccaggggggtctgctcccttcctgtctgtggaaacagcaggctgagtcaccatgacagcctgctaattaaaatgacctcccggaaatgaggattagaacacagggagaggaagggaggctccagggaggaaaatcccttagcacagagctccactaaagcattttttgtttgtttgtttgtttgtttgtttgtttgggttggagattattgaagtttgctacaaaaatcaaaaagaaaacttgttctcctttgcatgctagttttcagaaatgatgacaaagagccatatgttgattggctacaaatgtcatgttgtatatacagcttctcccctgggttcgttttgcccagaggaacacaaataaagtgttttgtgctaaaaaaaaaaaaaaaargctttt

SEQ ID NO: 16719 - DNA, 303 bp, Homo sapiens
tagttatagcaattctctgatcactttgcttgcatacgtccacctctccgggtcatgtgcttctcaagagtgggagctttgccarggratcgtttgtcagatttctgatgtgtgkaattcatccaggtctggaagggtctttattcagtctgaaggacattttaattttgtatagtattttcatcacaaatcctcgkacacatgagggtawtggrrradavttgramcctttcctttgtgctcactgtcaccatgacatctcamccaagttkcatgtcccamcaggttggttttaagaacatk

SEQ ID NO: 16720 - DNA, 488 bp, Homo sapiens
taacattgttttacacttttgcaaatctctttattcccctggcttaatagaacacagctggattctcatatcagtttcttcatctactctgttgcaatatattgttttggttgatgtatatgaaaaaaattcagtctcacacagatatacagttggaatacaaggaagtattttaatagctttttcaggtaattttgggatatattttgattctacaaaggcagatggcagtttcttaaaagttaattgtggtgtggatctgaaagcattatcagtgaacatttttcaaatgctattacattaaagtgcactggttgattttgtactttgaatgattttktttaataatgcatgattttgtgatatcaggcattgctcatcttgaaaatatttattcgctgagttaagcaaatattccaagtgttgatgcattttattgtatactaccatgaaatcattttgttagtgtcttcaccamtctcatcagg

SEQ ID NO: 16721 - DNA, 152 bp, Homo sapiens
gtccggtcaaggcagccatctcgccgtgagacagcaagtgtcggatccgcagcgcackagccgawtgttgtcctctacagccatgtattcggctcctggcagagacttggggatggaaccgcacagagccgcgggccctttgcagctgcgat

SEQ ID NO: 16722 - DNA, 214 bp, Homo sapiens
aattgtgatgctgttgggaaaccctgatctaaagaaacatcaggccgggcgcggtggctcacgcctgtatgggaggccgaggcgggtggatcacgagggattccaatgttggaagcatttttagcgtacaacaacatccaagtggattactatgaatgcctagacctctatggcaaacagtctcttcgtggcctgtgctgaggactacatcagt

SEQ ID NO: 16723 - DNA, 485 bp, Homo sapiens
agatccaagatacccaggaaacccaagctgtgcaactaaaatccacacatggacacactacagtcaaactgcaaaatactaaaactgagaaagttaaaaacagccagtgaggagtcacaccacggacaaaggaacaataattagctaactggcttcccagcagcaaatgtcaaagccagtagaaracaaaggaagaataccttcattgtactaggagaaaatgctgtcaacctagaactctttcaagaccagggtaattttcatacctaagagacatataagagatttaccaacaacataccttctcaatggaaattccaattcattttagatggaagggaaattatctcaagaaaagactgaaatgtgaaacataaaagctgactgtatgctgggaataaagttagcctcaacaaatttccaggtacagtattgattttaattaggctccmtgatcacaatgcaatcaagttagaaatcaccaa

SEQ ID NO: 16724 - DNA, 458 bp, Homo sapiens
agatccaagatacccaggaaacccaagctgtgcaactaaaatccacacatggacacactacagtcaaactgcaaaatactaaaactgagaaagttaaaaacagccagtgaggagtcacaccacggacaaaggaacaataattagctaactggcttcccagcagcaaatgtcaaagccagtagaasacaaaggaagaataccttcattgtactaggagaaaatgctgtcaacctagaactctttcaagaccagggtgaaacataaaagctgactgtatgctgggaataaagttagcctcaacaaatttccaggtacagtattgattttaattaggctccctgatcacaatgcaatcaagttagaaatcaccaacaagaaagagaaaaacccaatacatttggaaattaaagacaattctgacaacttgtaggttaaagacaactctttaaagtctcaga

SEQ ID NO: 16725 - DNA, 373 bp, Homo sapiens
agatcsaagatacccaggaaacccaagctgtgcaactaaaatccacacatggacacactacagtcaaactgcaaaatactaaaactgagaaagttaaaaacagccagtgaggagtcacaccacggacaaaggaacaataattagctaactggcttcccagcagcaaatgtcaaagccagtagaaaacaaaggaagaataccttcattgtactaggagaaaatgctgtcaacctagaactctttcaagaccagggtaattttcatacctaagagacatataagagatttaccaacaacataccttctcaatggaaattccaattcattttagatggaagggaaattatctcaagaaaagactgaaatgaaaagg

SEQ ID NO: 16726 - DNA, 581 bp, Homo sapiens
agtcttgaatgagggagccccactgtgggagcaccgtgttccctggggacccaagagaatcctcccctgctgggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctattcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacgatattattctggtgtgaaagtgggtgtctttaattaattttaatgacggattctcaaaggtacatcagcaaaacagtctgatgaaaatggggaggctgcctatgatctgccagctgaggactggatagttgcaaacaaagatctgattgacaagacga

SEQ ID NO: 16727 - DNA, 474 bp, Homo sapiens
ctgacacctaggccccgggggtggctctgcraagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgattgaagcaaatttttatttaattttcgagtctgcacctattttggccaagtaaagacagtaaaatagggagagcctcctgaggatctgaatttattgccctggcacataatttttagctctttctccctttgtctcataaccatgtccaccaacgagaatgctaatacaccagctgcccgtcttcacagattcaagaacaagggaaaagacagtacagaaatgaggcgtcgcagaatagaggtcaatgtggagct

SEQ ID NO: 16728 - DNA, 492 bp, Homo sapiens
ataaatgtagttaaagaactactcatctctttcctagattggatatagagggtttttttgaaaacccttggaacacaatttttatttgctttctttgctacagtagtaccaaagcagtagatttaaattagacggtagtctaatagacataaagtagtagatacgaagtagatttaaattagagattttaaaacagtgtatttttatgtaagtagcttagccaaaaataaaaaaaattacatatgtacttggaataaactgatttggaaagtaaaatggtattatctttatttggtaaacttagaatcactttttttccttaatgaaaatatttctaaaagcatcaaagagattctagatatgtgaacttccatgtaaataatggtcattatttacaattaagaaatcctggccgggcgcggtggctcatgcctataatcccagcactttgggaggccgaggtgtgtggatcatgaggtcaagagattgaga

SEQ ID NO: 16729 - DNA, 381 bp, Homo sapiens
ctttctccccgccctgccgccgccccggggcgcasgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaaacaggcagcgtgccgtccctggctgcaggggctgctcttcggcagttctagccggccctgggtgcttaccagctgtatcaggatccaaggaacgttttgggggtttcctagccgctacat

SEQ ID NO: 16730 - DNA, 485 bp, Homo sapiens
gcatttccggcgacacctcgcagtcattcctgcggcttgcgcgcccttgtcgacagccggggccttcgtgagaccgctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttcccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggt

SEQ ID NO: 16731 - DNA, 426 bp, Homo sapiens
cgacgtcccgcctttctccccgccctgcsgcggccccggggcgcacgcgcacgcaatcgcgtttccggagagacctggctgctgtgtcccgsggcttgsgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctggcagggctgctcttcggcagtctagccggcctgggtgcttaccagctgtatcaggatccaaggaacgtttggggtttcctagccgctacatctgttacttttgttgggtgttatgggaatgagatcctac

SEQ ID NO: 16732 - DNA, 433 bp, Homo sapiens
acgacgtcccgcctttctccccgccctgccgcggccccggggcgcmscgcacgcaatcgcgtttccggagagacctggctgctgtgtcccgcggcttgcgctcccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgytcttcggcagtctagccggcctgggtgcttaccagctggtatcaggatccaagggaacgtttggggttttcctagccgctacatctgttacttttgttggtgttatgggaatgagatcctactacta

SEQ ID NO: 16733 - DNA, 316 bp, Homo sapiens
agattccccgccgcgttccctggactcaggagctcgccgcgatgycccgccccactctccacccgctgaatgcagggcgcatgctgctacttggcggctcaagccccgcccgcaccgtccccattctctgaccgcccctstcccggtacactgcgcaggcacaacagagccgctccchtctcctcgccccgccaccgggacgagagcgcccgccgctgcatttccggcgacacctcgcagtcattcctgcggcttgcgcgcccttgtagacagccggggccttcgtgagaccggtgcaggcctggggtagtctcct

SEQ ID NO: 16734 - DNA, 460 bp, Homo sapiens
attttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaa

SEQ ID NO: 16735 - DNA, 331 bp, Homo sapiens
aatcgcgtttccggagagacctggctgctgtgtcccgsggcttgcgctccgtagtggactccgcgggccttcgsagatgcaggsctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggsagtctagccggscttggtgcttascagctgtatcaggatccaaggaacgtttggggtttcctagccgctacat

SEQ ID NO: 16736 - DNA, 298 bp, Homo sapiens
cacttagagcaagatggcagcccgcgtccctgtgtgaagccgtctgcagcagctgccagagccctgcttgctgtttcctttmtcaccasccacctcacccggaaatcccctgagtcttgstttgtcgcccaggttggagtgcagtggcacgttctcggctcagtgcacctccgcctcctgagttcaggtgattctcctgsctcagcctccctagtagctgggattacaggacaaggagagggacaaattccttcttggsatccttatggccstgtgacctgctaatgaatgctgactc

SEQ ID NO: 16737 - DNA, 527 bp, Homo sapiens
cttcacctcagcacaaaaacagctggcctcatccatcatgtgtagccgattcagcttctctgggaaactccaaaaccctctcaaagggtcctcaacctctgccctcaaaccactatcgccgtgaggatgacgatgacaatgacaatgctgatgacaatgatggcctgtgtgcaacatctgctggccttcccagaggctctaccaggaatcccccacagcctgggacttctgctcctggaaacagttaaggctttggcaagaggctctcccacaaggcaattsgatctcccctgtctgtctgtragggttcggggcactgctgtggcacgccagacgcagcagctactttctgtgaacagcctcctcataaatgtcagtcctgttggggggtggggagggggccttgatttattatatagcttttggacagttcctacagaaatattgccaaacagtggaataatcaactctttcamtcaagccccctcagacttttttttaatgaaagaataaagtacgcaatgagc

SEQ ID NO: 16738 - DNA, 128 bp, Homo sapiens
atactctggtttctcttcagatcgtataaatctttcgccttttactaaagatttccgtggagaggaacaactctgagtcttaagctaattttttgaggccttgaaaaaaaaaaaaaaatgcgaaaagc

SEQ ID NO: 16739 - DNA, 116 bp, Homo sapiens
tactctggtttctcttcagatcgcataaatctttcgccttttactaaagatttccgtggagaggaacaactctgagtcttaacccaattttttgaggccttgctttggcaaggcta

SEQ ID NO: 16740 - DNA, 146 bp, Homo sapiens
atatactctggtttctcttcagatcgcataaatctttcgccttttactaaagatttccgtggagaggaacaactctgagtcttaacccaattttttgaggccttgctttggcaaggctaaaaaaaaaaaaaaaaaaaaaaaaaaaa

SEQ ID NO: 16741 - DNA, 292 bp, Homo sapiens
gacaagaggatgggactgcagttgtggctgccaggttggagtgcagtggcacgattctcggctcagtgcaacctccgcctcctgagttcaagtgattctcctgcctcagcctccctagtagctgggattacaggacaaggagagggacaaattccttcttggcatccttatggccctgwgacctgctaatgaatgctgactctgagttgctactagaatttggtttctttgtggcttcccaggaattgtgagctatgttggataaggacctgsaaggaaggaatgaggaagc

SEQ ID NO: 16742 - DNA, 565 bp, Homo sapiens
tctccacaggctctccgagagcgccgcgccacgaggtgtaactggagcaagaaagaggaaaaacaggaatacctgtgagaggaacccaagtacatgcagtgcacagaagagcaagtcacttgacttgctggcggccaccccgttaatctgcagcagagcctggacttcagtctgcatctgtgaaacccagcgcatgggtgcgttggtcaccaccgcacagcctccccgtcagacacccacgtttcgccaaaaatttattcaaataattactcctttgcttgttcctttcccaccgcccacttctgacatttttattcaaaagtaggaaatagaagagaaatatgtttgagtgctggtctgctgtgacttcattgaccttttaaatcctcaccatctagtacctaagcacagcgagttggacaaactctcacagtattcacaaagtaaattgccacaacctcatcagctcatccaacacttgtccatgcttttgattttgtccttcttaaaatgtacccttcttaaaataaaccactttatagacttgtaaaaaaaaaaaaaaatg

SEQ ID NO: 16743 - DNA, 342 bp, Homo sapiens
accttttgaacaagatttcctgtactgtggagaacagttctaagcctgttaagctaccattagtaactaaaaacctgtatttaggaggcatgttatgctccaagggtgtgaccattgcgaccactcctatctgacgtgctcacatttcactatttcatacatgtggcaaagaaaaacaggaatatgagaagaaactcaatcggtttcaagacactgagaccccatatgtgggggtgaagtctccaaatcaacaccttttagataattaatataggtttataaccccttatctgaaaccctagagttttgaactttcagggttttggaatttttaaaaaaaaa

SEQ ID NO: 16744 - DNA, 432 bp, Homo sapiens
  misc_feature 428: n=a, g, c or t
acttccggtagagagtcccaaacggccagcggtgggaatttgcggtgggaaggatacgagcaagataaagcagcgagggatttaagtctggcaacagttggactgctggattttcagagaagtgttccccaaagcaaattatagtgctaatttccaatgttccataagcgtggcaagaaraatgggaaatycycggtaaggtatatagtattatttctagaaataaagatkaaccaatccaatattgattttttgtttgtttaatcctggcagtattcttaactaaattgtattcattcttccctttactttccagactttttaattttatttatttttttattttttgggacagaggttgcagtgagctgagatagcaccactgcactccagcctgagcgacagaatgagactccatctcaaacaancaaa

SEQ ID NO: 16745 - DNA, 536 bp, Homo sapiens
aatgacttatggacatcttcacatagatatcacacagttaccttaactcaacaagtccaaaacctaactcctcccttcctctgcaagtctgctccatgttcatcccatagtgatctggattatcatcctgtggaactggccccaaaagctccatagaagtgtcaggaccaagaacaacttcagctccatcaaacaaaccagaaagtcctcctttggcctaaaagacattggagtagagacatgtgagaaaagacagaggcactgactttgacaagttaacacatcatttcaaacaagttcctaaatttacattctcctctggagggtcatgatcaatgtgcaacaaagcctttactatttgttcagctttgcagatgatgaaaaacaggagaattacttcagtaagatgaaaagttatgctcataaattttggtaattatgaataagagataatttcatgcatagatcagtttaattctgccttttactagtactaacttcttgtcattaaaataaacttctaaaaaagtagccaa

SEQ ID NO: 16746 - DNA, 498 bp, Homo sapiens
ctttttcaggttcccgtactgacgtgtcgaggtggtcgcatcccggcgtagaggactaggaatcgggagtcactggccgtatgctggaggctggagacgcgggasyggcttgcctcgctgcggttgttggcagcgatggagatggcgcggctggagaggaggcagcactcggggaagcagcaccaaggcaggcatcgtcattctgcatatgcaggccttgactggcagcagagctcactgtcctgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgcttatgtctgttcctccttcatttctctcaagggaaatggctaaggtggcattgtctcatggctctcgtttttggggtcatggggagggtagcacca

SEQ ID NO: 16747 - DNA, 461 bp, Homo sapiens
atttttggcttttctgtattggtgtgcggggctgctacgtgctcggcttagagaattagaagggtccgtctctttttgcccactggagtctggcacttggggcactgcctccctgttggtggtggtggtgatggagctgtaggagggaggctagcagtgggagcttctcctgctgggctggaagacaagcagaaggaagaggcaccaccgcatgctggaggctggagccacggcggcttgcctcgctgcggttggtggtgacatcggagaccgcagctacgagctaaagcaagctcagtactactggtgatttggaaagtgccttcatattgtttttgccagttctcacctgagaaccctgcagatgcccatgagaggctgtgcctttacaaggastctcartgatacagctgattttcctccatactctaatccccttcatggctgcagcatcaacagat

SEQ ID NO: 16748 - DNA, 474 bp, Homo sapiens
atatttcctttttcaccacaggcctcagtctgctcccaaatatccctctgcagtttctagaaaaactttctttccaaaatgctcaatcaaaagaaagtttttactccatgagatgaatacacaaatcacaaagcagtttctcagaaactttctttctagtttgtctcagaagatatttcctttttcaacacaggctcaatgcactcctaaatatccctttgcagattctagaagaacagactttctaaattgctaaatcaaaaacaggattaacgctgagagatgaatgcacatatcacaaaccagtttttcagaatgcttctgtgtagtttatatctgaagatatataccctttttcacataggcctcgatgctctaaaaaatatccctttgcatattctaccaaaactgtgtttccaaattgttccatcaaaataaagattaaactctgtgagacgaaaaaaaaaaaaaatt

SEQ ID NO: 16749 - DNA, 503 bp, Homo sapiens
ttccgccaatgggtagattcattcagtgagatgtctgaggctctatggtcggtacatgacagtcgtgaacagtatttcacatacctggtcaatggtactgatttgatcccccttctgatttcttcttttcaacaatgttaataaaattctttcccgttgtcctgctaatgacatatatgtaagcctatttggccagtttaaatatttataaacaaaactagtaagagttgttaatgatttttctgaaaattagagcagattagagcagatttgtagttttcaacggctgaagaaataaatccttctaaatgagccagattaatcgtaagttactgatttttttattgaaattgtatttcattgaattgtatttcattcagctgaatgaaaacaggccaggataaagctaacaagtaggctacctatgtgagtagacacaattaagataaattacattaaggtgtgtgattttatattaggtgtttttaacctgggtctgttca

SEQ ID NO: 16750 - DNA, 530 bp, Homo sapiens
aaaaaaacgataaactagggaaagcgccccattgcctggcacgtggtgggtgcgcaataactgttaggtgactttcctcgagtggcttatcaaagctttacccaagctgagaaacactagagcatcagtaggatgagactctctatggactccttgatctctcccctctaagctctcctctcattgaggactcactggcagtctgttataatatctgaacattctacttcaaatcagccctgcacgttggaagggctggcttctgtccccttgaaggggaagaaagatttgaacataccccagcctgaggatgccactatagcctgcgtgttctcatgtgctaatggctaggagctgtgactttccattgagccgggacccagccagatctcaaaacaaggagccaggagagacacctcaactatgttctccttcaccccttcagtctgttgccggtgcttgcctttgstgagctctactgaaaaccagaagacaagawagttcagcttgatgtactggatgggtccaaa

SEQ ID NO: 16751 - DNA, 794 bp, Homo sapiens
tgccgtgtagtcgccgccgtcgctgccgctgccgctgccgccgtcgttgttgttgtgctcggtgcgctgagctccgcctccgcgascggttccgtccccttcccgccgccgccatgaagtgatgttcaaggaggaccactcgctggaacacagatgcgtggagtccgcgaagattcgagcgaaatatcccgacaggtatccgcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctgaaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctc

SEQ ID NO: 16752 - DNA, 394 bp, Homo sapiens
tgccgtgtagtcgccgccgtcgctgccgctgccgctgccgccgtcgttgttgttgtgctcggtgcgctgagctccgcgctccgcgagcsgkttccgtccccttcccgccgccgccatgaagtggatgttcaaggaggaccactcgctggaacacagatgcgtggagtccgcgaagattcgagcgaaatatcccgacaggttccggtgattgtggaaaaggtctcaggctctcagattgttgacattgacaaacggaagtacttggttccatctgatatctgtggctcagttcatgtggatcatcaggaaaaggatccagcttccttctgaaaaggcgatcttcctgtttgtggataagacagtcccacagtccagcctaactatggggacagct

SEQ ID NO: 16753 - DNA, 490 bp, Homo sapiens
caattaaaagagtaagccatatgtataagaaaactatgataagagtttgaggattgaatgagtgactgtgttgtcagcatcttatcactgtgggcttactatgatgcctttagaagtcttttagaatgataatctttattttggaagtcagttatccttacatataaagttccaatttagagcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggraatggt

SEQ ID NO: 16754 - DNA, 488 bp, Homo sapiens
ataattctaacttcctgtcagttgaagacgataattctaacttcacacttaattaaaagacagttgcgattctgcagcatcaaatggctatggcagcagcagcagcacaaacagctcagctacatcatcatcggcatacaggcagccagtcaaaaagtaaaatgaagagaggcaygccaaccactccaaaattttgagtcttgcattactttttgttccttttttaaaaacacaagagcactgaatcaaaagaattgagtttctactttttgttttttttaatgtgtcagtattttacattrctagatgtacaaactttatacagaagcacaaccttatcatttttaaataaaaacagggamatggtttaacaaactagggttggtttgcctaagtcattgctttttaaaaatggtttcactatacataatatatatggaagtgacctaagaaataatagaaacatctttcagaaaaaaaaaaaaaaa

SEQ ID NO: 16755 - DNA, 431 bp, Homo sapiens
tttggtttaaaaaatacttcaagtctcaggcccttaaatctactccagcagcaacagcagctctcccagtttacaccacaacaacctcagcagcccacaacttgtagtcctcaacagccaggggagcagggttctgagcaaggttcaaccagtcaagaacaggccttatctgcatcagcaagctgctgttattaaccttactggagtaggaagttttatgcagtcacaggcagctgtgttgtctcagcttggctctgcgagaacagacctgagcaaagccttcctcagcagagattccagctctcctstgcctttcaacagcagcagcaacagatacaacagttgcgattcttgcagcatcaaatggctatggcagcagcagcagcacaaacagctcagctacatcatcatcggcatacaggcagccagtc

SEQ ID NO: 16756 - DNA, 245 bp, Homo sapiens
acttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtaggcaaaaaaaaaaaaaaaaa

SEQ ID NO: 16757 - DNA, 248 bp, Homo sapiens
cacaggatacagtggaaagcacagaccttgggaaagcctgtctagccagggaaggcctcttggaaaaggtgactttctatttaagacttaaagaatgatcctcggccaggcacagtggctcacgcctgtaatctcagcacgttggcaggctgagacgggcggatcacctcaagtcaggagttcgagaccaccttgactaacaaggcaaaaccctgtctctactaaaagtacaaaaaaaaaaaaaaaaa

SEQ ID NO: 16758 - DNA, 222 bp, Homo sapiens
aggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaaaaaaaaaaaaaaagct

SEQ ID NO: 16759 - DNA, 180 bp, Homo sapiens
artcccgctccgtcctcctcgcctgccaccggtgcacccagtccgctcacccagcccagtccgtccggtcctcaccgcctgccggccagccccacccccagccaggctatggttgccaccccaacccaataaaactgatgttactagcctctcaaaaaaaaaaaaaaaaaaaaaaaaaaw

SEQ ID NO: 16760 - DNA, 191 bp, Homo sapiens
agtcccgctccgtcctcctcgcctgccaccggtgcacccagtccgctcacccagcccagtccgtccggtcctcaccgcctgccggscagscccaascccagcmaggctatgggttgcsaccccaacccaataaaactgatgttactagcctctcaaaaaaaaaaaaaaaaaaaaaaaaaaaaaaaaaaaar

SEQ ID NO: 16761 - DNA, 525 bp, Homo sapiens
taattttgagtttcggttttacttgactttcagtacctcccattgctgagccttttgaggattctcttacgtattcataagtgtgattctcatttttccagtgactcattttccttgtatttgctttgaaatttcttgtagttttctcatttcacattctctttgacctaatttttatgcagaagccaataatcaaaagaaatctttgtattcttacagggatacctttccgtaaagatgaataaaatgtgtgttttgatgtgccatttgacattttctgtcagatctgttgaaatctttctcaaatgtctccttctaccttaggcatttaatgatgcttccaaccagatatatcatcttctgaaaatctttcttcttactttggaaattttttcttctcttttgagactcttttacatcttatgttatttgtatttgaatgcttttcttacactctgccctcctctgtacaccagactgtaacttctttgaggaccttaactgatacagaattgctggataaaa

SEQ ID NO: 16762 - DNA, 514 bp, Homo sapiens
gtaccatgtttcttgagagagtagacaaaatgttatttcaaacagatgttattcccaaattaataccaacttaatgcagatccctaaaaaaacaaaaacaaaaaaaacccctgaggattacttttgcaactaaatgcacatggaaaactcaaccagtgagaatgtcaaagaaaaaaatcagtaataggatgggagacatctagttttactatatattaaaacaatattcaaaactagaaaagcagagttttcactgggtgcagtagctcacgtctgcaatcccagcactttgggagtctgaggcaggcagatagcttgcgcctaggagttcgagatcagcctacacaacatggcaagacctggtctctacgaaaagtacagaaattggccagcatagtggtacgcacctgtaatcccagttacttgagaggccaaggtgggagaatcatctgagcttgggaggtgggggtcggtaagctgatttcacgccactgcactccagcctgggcgacgg

SEQ ID NO: 16763 - DNA, 474 bp, Homo sapiens
gtaccatgtttcttgagagagtagacaaaatgttatttcaaacagatgttattcccaaattaataccaacttaatgcagatccctaaaaaaacaaaaacaaaaaaaacccctgaggattacttttgcaactaaatgcacatggaaaactcaaccagtgagaatgtcaaagaaaaaaatcagtaataggatgggagacatctagttttactatatattaaaacaatattcaaaactagaaaagcagagttttcactgggtgcagtagctcacgtctgcaatcccagcactttgggagtctgaggcaggcagatagcttgcgcctaggagttcgagatcagcctacacaacatggcaagacctggtctctacgaaaagtacagaaattggccagcatagtggtacgcacctgtaatcccagttacttgagaggccaaggtgggagatcatctgagcttgggaggtggggggtcggt

SEQ ID NO: 16764 - DNA, 498 bp, Homo sapiens
ccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagcactgtggcatctgaggaagacccagggtacagtattagcatttctttcaaccctaagtatgggcatgtgac

SEQ ID NO: 16765 - DNA, 330 bp, Homo sapiens
atttttccctgagccggcggggcagagcgcagggagctggaggtcggcgcttcctctcgtgcttggtccactgacgcgcggccccgccacgaggagcatcagatctccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaaggaaaaaaaaaaaaaaaygcgaaa

SEQ ID NO: 16766 - DNA, 233 bp, Homo sapiens
aacacgcacgccgggcgycaggtttataaagggagagagcaagcagcgagtcttgaagctctgtttggtgctttggatccatttccatcggtccttacagccgctcgtcagactccagcagccaagatggtgaagcagatcgagagcaaggatgttgcttcagagtgtgaagtcaaatgcatgccttgcstgaactaaccasgttatctatttgcaataaacccatttcttaa

SEQ ID NO: 16767 - DNA, 470 bp, Homo sapiens
agaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatcaaaggttggtaaacgtgtgatctcagctctggaaaccccattatgcttatgtcaacggtgatgtctgagtgttgaggtttgggaaagactgcttttcaggaagccttggacgctgcaggtgataaacttgtagtagttgacttctcagccacgtggtgtgggccttgcaaaatgatcaagcctttctttcattccctctctgaaaagtattccaaacgtgatattccttgaagtagatgtggatgactgtcaggatgt

SEQ ID NO: 16768 - DNA, 304 bp, Homo sapiens
atttttccctgagccggcggggcagagcgcagggagctggaggtcggcgcttcctctcgtgcttggtccactgacgcgcggccccgccacgaggagcatcagatctccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaa

SEQ ID NO: 16769 - DNA, 464 bp, Homo sapiens
attggtcctagaaagacacggttgtcctgggagtttgtagtgttaagttgcaacaacaacaacaaaaagcaacaaaaccagcttaggataacactttttgttgcttgttcttaaagatgtctcactatgattaaracccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagataagcactgctgcttgtctggatataggctgaggatgattgagagaagctgtgggaactgacacaagggtctgcataggtcatcctgtgaccctggcgactatgttaccaactgacagacagatctttcactgtatcctagcagggcaggtagtccac

SEQ ID NO: 16770 - DNA, 358 bp, Homo sapiens
atttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttcgggacaactggtcagttgaaagtcccaggagttcctttgtggctttctgtatacttttgcctggttaaagtctgtggctaaaaaaatagtcgaacctttcttgagaactctgtaacaaagtatgtttttgattaaaagagaaagccaaccaaaaaaaaaaaaaaaaa

SEQ ID NO: 16771 - DNA, 412 bp, Homo sapiens
tgttgttgttgtttgagacggaggctcgccctgtcgcccaggctggagcgcaattgcgcaatctcggctcattgcgacctccacttctcaggttcaagcaattctcttgcctcggcctctcaagtagttgggattgcaggcacccaccaccacgcccgactaattttatgtatttttagtagacacagggtttcaccatgttggccaggctgctctcgaactcttgacctgaggtgatccaccttggcctcccaaagtgttgggactgcargcgtgacactgcacctgacttaatcttagcattcttaatgaagacttacagtacataagccatgatttttttggtcaggcaatcaatagttacttattagtgtctactcaatgcaaagcacctttcttggcattctggaga

SEQ ID NO: 16772 - DNA, 542 bp, Homo sapiens
acttcctacttctttttgtctctgtattctgaatagttcttaccaatcttcaaattcactaattctcttttcaacttcttcttgtgtgttgttaattctatccattgagttttatatttcaattgttatattttttatttctagaagtttgcttagttctcttttaaatatgctaggtttttaaaaaaatagtttcctattccctgaaaatacttggtttttcattttcaaagcatagtcattttatttcctgtaactggaatattacaatatctaaattaattgtatatttgtttctgctctttgttgttttttgctgggtcttgtgcatagtgacttatttccttgtggttcttggttacgtttgtctgtgagttgctttttgtttttccttggaaaattatttttgagttgtcttagaggcctaaagtcaagatgcctttgcctctgactagtgcatagaaacaccatcagtttggaaacaacttaaaattatggkttaaagttttttggactaccttggtgttgtaaatactgtgtga

SEQ ID NO: 16773 - DNA, 418 bp, Homo sapiens
cttttttctttgtagccacctcaggggaagcaacagatcgtcactcggtgttctcaccgaaagcacgtaatcgccggtgtaactcatgttggctggggggcctcccggcgcgcgcggagaggctggggtgcgcccccatgcagcatgcttgtgctcaattgcagggtcctcgttctcgagtgtgcagagggcggtgagagctcaactctcgtccccacctcccamccgcagctccccgggtggktragggatgcwtggactggggatagccaggtgggagtccgtcgctgtgtggcctgtggtctcggagtctgttctcctggagtctcgcatttgcacccccttcttcgcagtccccctcccatagacttgctctgggaagcgcctctgcctccgaccctagccggaaccccttcgg

SEQ ID NO: 16774 - DNA, 256 bp, Homo sapiens
acgagaccagttattcagggtccatttctcttggatgtaaaggagtcctgggtaaaatgtggctgtaacctaaaccaactagtccttgtgatttgtttctgccctctgtgtttcctgttygtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaaaaaa

SEQ ID NO: 16775 - DNA, 359 bp, Homo sapiens
cttttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggastgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccwmaaaaaaaaaaaaaaaaagg

SEQ ID NO: 16776 - DNA, 132 bp, Homo sapiens
cttttttcagcgcctgcaggttccgggaggtcagctcccagccgaggacgtcggatgtcatcgtccttgctgctttgccaccccattcccgtcaataaagtggtttgaacccaaaaaaaaaaaaaaaaaagc

SEQ ID NO: 16777 - DNA, 253 bp, Homo sapiens
  misc_feature 245: n=a, g, c or t
ctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggastgggagggggctggcgggcgggcgcgcgcacacccgctgatctatcantwctcgtt

SEQ ID NO: 16778 - DNA, 135 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaa

SEQ ID NO: 16779 - DNA, 185 bp, Homo sapiens
  misc_feature 111: n=a, g, c or t
ctttcagcgcctgcaggttccgggaggtcagctcccagccgaggacgtcggatgtcatcgtccttgctgctttgccactccattcccgtcaataaagtggtttgaacccanaaaaaaaaaaaaaaaaaaaaaaaaaaaaaaaaaaaaaaaaaaaaaaaaaaaaaaaaaaaaaaaaaaaaaaaaaa

SEQ ID NO: 16780 - DNA, 134 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaa

SEQ ID NO: 16781 - DNA, 157 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaaaaaaaaaaaaaaaaaaaaaaaa

SEQ ID NO: 16782 - DNA, 129 bp, Homo sapiens
  misc_feature 105: n=a, g, c or t
ctttttttttcagcgcctgcaggttccgggagctcccagccgaggacgtcggatgtcatcgtccttgctgctttgccaccccattcccgtcaataaagtggtttngaacccgaaaaaaaaaaaaaaaaa

SEQ ID NO: 16783 - DNA, 140 bp, Homo sapiens
ctttcagcgcctgcaggttccgggaggtcagctcccagccgaggacgtcggatgtcatcgtccttgctgctttgccaccccatttccgtcaataaagtggtttgaacccaaaaaaaaaaaaaaaaaaaaaaaaaaaaaaa

SEQ ID NO: 16784 - DNA, 190 bp, Homo sapiens
ttttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaaaaaaaaaaaaaaaaaaaaaaaaaaaaaaaaaaaaaaaaaaaaaaaaaaaaaaaad

SEQ ID NO: 16785 - DNA, 139 bp, Homo sapiens
ctttcagcgcctgcaggttccgggaggtcagctcccagccgaggacgtcggatgtcatcgtccttgctgctttgccaccccattcccgtcaataaagtggtttgaacccaaaaaaaaaaaaaaaaaaaaaaaaaaaaaa

SEQ ID NO: 16786 - DNA, 140 bp, Homo sapiens; identical to SEQ ID NO: 16783

SEQ ID NO: 16787 - DNA, 213 bp, Homo sapiens
atttttgctgcccggacgcggasagraggctgagagagtcggagacactatccgcttccatccgtcgcgcagaccctgccggagccgctgccgctatggatgatcgagaggatctggtgtaccaggcgactggtccgagcaggctgagcgatacgacsaaatggtggagtcaatgaagaaagtagcagggatggatgtggatagtgtctccta

SEQ ID NO: 16788 - DNA, 279 bp, Homo sapiens
  misc_feature 25,133: n=a, g, c or t
atttttgctgcccggacgcggrvgnaggctgagagagtcggagacactatccgcttccatccgtcgcgcagaccctgccggagccgctgccgctatggatgatcgagaggatctggtgtaccaggcgamstgnccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaata

SEQ ID NO: 16789 - DNA, 455 bp, Homo sapiens
atttttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaar

SEQ ID NO: 16790 - DNA, 790 bp, Homo sapiens
acaaaccgaaccgtgaatctttgcggtttctctttccagccagcgccgagcgattggggcatctctcgggacaactggcacaagcgccgcaaaaccgggggcmagraggaaagcccytaccacaagaagccggaagtatgrartttggggcgcccccagctgccaacaccmaagatttggcccccgccgcatcccacacagtaccgtgtgcgggggaggtaaacaagaaaataccgtgccctgarggttgacsttggggaawtttctcctgggggctcagagtgttgtactcgtaagaacaaggatcatcgatgttgtctacaatgcatctaattacgagcykgktycgtaccaagaccctggtagaagaattgcatcgtgctcatcgacagcmayaccgtaccggacagtggtacgagtcccaactatgcgctgccccctgggccgcaagaacgggaagccaaagctgactcctkgaggaagaagagatttttaaaacawsaaaacgatctaaaaaaaattcagaagaaaatatgatgaaaggaaaaagaaatgccaaaatcagcaagtctcctgggaggagcagttccagcagggcaagcttcttgcgtgcatcgcttcaaggccgggacagtgtgggccgagcagatggctatgtgctagagggcaaagagttggagttctatcttaggaaaatcaaggcccgcaaaggcaaataaatccttgttttgtcttcacccatgtaataaaggtgtttattgttttgttcccaaaaaaaaaaaaaaaaagg

SEQ ID NO: 16791 - DNA, 280 bp, Homo sapiens
ggagcgagaggctgagagagtcggagmactatccgcttccatccgtcgcgcagaccctgccggagccgctgccgctatggatgatcgagaggatctggtgtaccaggcgaaggcgawgsaggctgagcgatacgacgaaatggtggagtcaatgaagaaagtagcagggatggatgtggagstgacagttgaagaaagaaacctcctatctgttgcatataagaatgtgattggagctagaagagcctcctggagaataatcagcagcattgaacaaaaa

SEQ ID NO: 16792 - DNA, 382 bp, Homo sapiens
  misc_feature 335: n=a, g, c or t
actcaggggctggacgcctcactcccgtttccgagccataaaaggtctaggaccgcttcccccgagccagcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtagtcatcttggagggtcgtctcaagtattgaacaaaagacggaaggtgctgagaaaaaacagcagatggctcgaggatacagagrnaaaattgagacggagctaagagatatctgcaatgatgtactgtctcy

SEQ ID NO: 16793 - DNA, 281 bp, Homo sapiens
  misc_feature 200: n=a, g, c or t
ggagcgagaggctgagagagtcggagacactatccgcttccatccgtcgcgcagaccctgccggagccgctgscgctatggatgatcgagaggatctggtgtaccaggcgaaggccgagcaggctgagcgatacgacgaaatggtggagtcaatgaagaaagtagcagggatggatgtggagctgacagttgaagaaagnaacctccdmatctgttgcatataagaatgtgattggagctagaagagcctcctggagaataatcagcagcattgaacaaaa

SEQ ID NO: 16794 - DNA, 482 bp, Homo sapiens
cattcaacaaacattggctgttattatattagctattaaaaatttaagtcatttaggtcaatgaaacaggagggtttccagaattatacccaattaattatacatgggaaggtgatgaaggtagcatgtcaaattggtataaaaagatggaatattaaataagtagggatactgtatcagataggaacatatttggttgcaagaaacaaaaattcctgtgattactagcttcactgtgagtttattttttcacgtaataaatccaaggttacataatccataactgatatggcagtttaacagtgttattaagaactcaaggtccatttattgctctattctgccatctttggtgagtggctttcatcctcattgtctcagaaaagttatttcacctctaagtattacatctacatttcaagcaggaagaagatgaagcttaagagaccaaatggagcatgtcagtcaaaggtgtccttatt

SEQ ID NO: 16795 - DNA, 429 bp, Homo sapiens
ttttctttctgacctaatctcctaatgaatacggasacctgtgcaattccaaccaacactctgctcttttcttccttcatagctgtcacacagaggaaacccaagacagcaacatattctggaagccaggtgaggagagtttctaagagggagagagtgaaaaattctgtcaaatgtcaaattcttttcaaggaagatgragcctgagaattgagcactggatttagcaatgtggaagttactggtgagcttgataggagcaaattgggggaaaaaaatgaaataaatttcaattagagtaggttcaacagagagcaggaacagstaaattagaggcaatgataaacagctttttcaaagagctgtgttttgttttgttacttttttttcttaaggtaaggraaagaatgggcattagctacaaagaca

SEQ ID NO: 16796 - DNA, 423 bp, Homo sapiens
ccaccggtgactgcagcttgacatcatagtatatccgtgagtcaagcggctgtgggtttttggctcttgcatctgctatagttctgtctcgggtgccatttgctaactctgttctctgtgtagctgcttttggcasctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaarcctttgaaatttgcccttatgatcctcaccacckaatcccactcagcagattccagtaccacctggcatcgtgcaggagaaag

SEQ ID NO: 16797 - DNA, 426 bp, Homo sapiens
attgtbmccaccggtgactgcagcttgacatcatagtatatccgtgagtcaagcggctgtgggtttttggctcttgcatctgctatagttctgtctcgggtgccatttgstaactctgttctctgtgtagctgcttttggcasctcctcatctctcttctaatccaccactcacagtcctakagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaaacctttgaaatttgcccttatgatcctcaycaycgaatcccactcagcagattccagtaccacctggcatcgtgcaggag

SEQ ID NO: 16798 - DNA, 108 bp, Homo sapiens
acttagggcgggasgacgaggsgccggwtggctttgttctgtctgaggccaggaagtttgaccgckctgccatgccgaaccgtaagccagccggaatgsttastattt

SEQ ID NO: 16799 - DNA, 176 bp, Homo sapiens
acttagggcgggasgcgtgggcgcgttggttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16800 - DNA, 134 bp, Homo sapiens
  misc_feature 14: n=a, g, c or t
acttagggcggganvscgtgggcgcggttttgttctgtctgaggccaggaagtttkaccgcgctgccatgccgaaccgtaagccagccggaatgcttactatttcttcgtgcaggagaagatccccgaactacg

SEQ ID NO: 16801 - DNA, 175 bp, Homo sapiens
acttagggcgggagcgcgtgggcgcstgttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16802 - DNA, 175 bp, Homo sapiens
  misc_feature 14: n=a, g, c or t
acttagggcggganccgtggggcgcgtgttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16803 - DNA, 174 bp, Homo sapiens
  misc_feature 14..16,26: n=a, g, c or t
acttagggcgggannncgtgggcgsngttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16804 - DNA, 175 bp, Homo sapiens
acttagggcgggasgcgtggggcgcstgttttgttctgtctgaggccaggaagtttgaccgcgctgccatgccgaaccgtaaggccagccggaatgcttactatttcttcktgcaggagaagatccccgaactacggcgacgaggcctgcctgtgstcgcgttgctgatgccatc

SEQ ID NO: 16805 - DNA, 214 bp, Homo sapiens
  misc_feature 16: n=a, g, c or t
acttagggcgggasgncgaggsgccgtggctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggagg

SEQ ID NO: 16806 - DNA, 241 bp, Homo sapiens
  misc_feature 16..17: n=a, g, c or t
acttagggcgggabgnncgaggsgccgtgctttgttctgtctgaggccaggaagtttgaccgctctgccatgccgaaccgtaagccagccggaatgcttactatttcttcgtgcaggagaagatccccgaactacggcgacgaggcctgcctgtggctcgcgttgctgatgccatcccttactgctcagactgggsgsttctgagggaggaagaaaaggagaaatacgcagaaatggctcg

SEQ ID NO: 16807 - DNA, 175 bp, Homo sapiens
acttagggcgggagcgcgtgggcgcgtgttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatc

SEQ ID NO: 16808 - DNA, 447 bp, Homo sapiens
accgggagcgtagccttttggcctacgcagcagccgcccgctccgctgcgcccggggaagggacaggggccgcgctgggcacccatatggcggaggaacccggcacgtagaggagttggacctaagaccgcgatcactctcacctcgcagagcccagctacgggcccgcagtctccgccgccgccaccacaccggcatgactaacggctcttcgcgcttcttcctccctcgccggtcgcgcgggaaaggaagagcgacatcggaagacagctcttaggcactccggtggccccgcctcttccgaatcctgactgcaaagcactgggcttgatgctggagcagaaaggcttatgatcttgttgccagaaagaatacacatgaaagcatatgattaaacaatctactcacttaaagataggtcatctctcctcaaaaaaaaaaaaaaaa

SEQ ID NO: 16809 - DNA, 457 bp, Homo sapiens
aaaaagatggcggcttcctagtgagtcggcggctgatttagaaggaggttcaggctacggtgagccgaagccacacaggagccatggaagtggcagagccagcagccccactgaagaggaggaggaggaagaggagcactcggcagagcctcgcccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctccaga

SEQ ID NO: 16810 - DNA, 400 bp, Homo sapiens
acgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccgggctgggccttcagctcatggcaaccccaaccamctctggctgggttatccagtgccatagaactggkcagccactggactggggtcttt

SEQ ID NO: 16811 - DNA, 528 bp, Homo sapiens
catgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctattttgaaaacaggtataagagatgatatgatacaaccctatagataatgtt

SEQ ID NO: 16812 - DNA, 190 bp, Homo sapiens
  misc_feature 54: n=a, g, c or t
attttttttttttcattttttsagttgtactaartggctgaaggttccctgggnacttgtgcagccctgggggatctgatgacaaagcagaggacccagaaattcggctgagaacagcggctcccggcctcactcctcggggtcccttgtattattttsagtccactgacsttcsattttaaaaaagcct

SEQ ID NO: 16813 - DNA, 266 bp, Homo sapiens
attttttttttttcattttttcakttgtactaawtggctgaaggttccctgggtacttktgcagccctgggggwtctgwtgacaaagcagaggmcccagaawttcgkytgagaacagcggctcccggcctcactcctcggggtcccttgtattattttcagtccactgaccttccattttaaaaaascctgactgccttttatgaaaaaaaaaaaaaaaaaaaaaaaaaaaaaaaaaaaaaaaaaaaaaaaaaaaaaaaaaaaaaw

SEQ ID NO: 16814 - DNA, 214 bp, Homo sapiens
attttttttttttcattttttcagttgtactaaatggctgaaggttccctgggwacttgtkcagccctgggggatctgatgacaaagcagaggacccagaaattcggctgaraamagcggctcccggcctmaytcctcggggtcccttgtattattttcagtccactgacctdvvattttaaaaaagcctgactgcctttatgaaaaaaaaaaw

SEQ ID NO: 16815 - DNA, 574 bp, Homo sapiens
caatgagcagtggtgtccatcacatatattatagaagcaagcgaggacattccaccctagaaatggttcagaaactcataggcacccttagctgatggaaacaatcaatatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagaaaaaaaaa

SEQ ID NO: 16816 - DNA, 506 bp, Homo sapiens
attaccgccggagccgccgagagccttagccgacggaaactggacactggaccggcagcgccatgagactcctcccccgcttgctgctgcttctcttactcgtgttccctgccactgtcttgttccgaggcggccccagaggctcgttagcagtggcacaagatcttacaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaaggtaatacagaagtattagttttaattcagatgtaggcattttaaaacaatgagcttgktcatatatatctgaatacccatatctgtaaagtaatattgktggcatttaaagggaatacgtaggtgatatagacacaataaaaaataaaccmaaaaaaaaaaaaaaa

SEQ ID NO: 16817 - DNA, 455 bp, Homo sapiens
ttacattgctgggtgcggtgacagatgataaagcagatgaaagtgtccttttatcaaataattaattcactcatcagcatttatcaggtatctgcagtgtgctgaggagtgtgctgcccagagaccaatgggacaggaagagctcctagcctgtttgtgctgagataatgtaagcagtgtgcagtggctcatgcctgtaattccagctactcaggaggctggggtgggaggagcacttcagcccaggagattgaagctgcagtaagcagcgattgtgcctgggtggcacagtgggaccctgtctttatatataaataaataaaaagattggatagatagatagatagatgctagatagataaaaattaatgtttaggaagtactgttctaatcaaaaattaaaattaaaaaaaattaaaaaattaaaaataaatagatcagacaaaaaagattta

SEQ ID NO: 16818 - DNA, 290 bp, Homo sapiens
cagtttgctttagttagaacctctgaaacaatgttgaataatgatcccgggctgtttctgatatgcgtggaaatccgcatgtgagagttgagcggtgagagtttcggcaagtggcttttaaaatgttggggtttcctttagtttgtcttgcggctgctgggactcaccggtagttgccagtcctgcctgagttgggcgccagggggcagcagtcacacagaatgaaacgtgggctgtgcccctggaaactggctgaattttgtcaaatgcctttacaccttctataaaaa

SEQ ID NO: 16819 - DNA, 270 bp, Homo sapiens
  misc_feature 264: n=a, g, c or t
cgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttmynhagggc

SEQ ID NO: 16820 - DNA, 524 bp, Homo sapiens
aaagtttgaaatgatgatgaaataagagaaagacattaaaaagatgggaagaatttgccaaaagtcaaagtaggagacatccatctaactaccatacattgccctcaagtctcttccttctcagccttgacctggccccccatcctttttgaattttgaggcttacattatatttacatttaatcctcacaattaccctgtgtgctgagtgttgtgattctcattttatggttgaggaaatcaaggctcacaggagttaaataacttgcccagggccatgtagctatttagtagcttctcagccttgacctgmctcctacactggaatggtccaacttagctcctttcccactcctccttcattttagaaactctactacatatcttttgcccatagcaaaaatcacagttccctgtcaaatttcaactttgtctcctcatctcaggtctccacccagtcttgactccattcctgcctcctcttttcatctctctgcttttgccagagttactggactttatgc

SEQ ID NO: 16821 - DNA, 559 bp, Homo sapiens
caataaatagtaacagcattcaagtatgaagttaagtgtagtgagtaactttagcaaacagctgtgaattttgagaaattaattttttgatactgaattaacctctttggagtttggaaagcagatgaatgatattagtttctgccttcgctagcatgcctttgttttgtccaccagagaacgatcagttcatggttcactcctgtattagaccattcttgcactgctaaaaagaaacacctgagactgggtaattgataagacaagaagtttggccaggcacggtggctcatgcctgtagtcccagcactttgtgaggctgaggtgggatgaccacttgatgtcaggagtttgagaccagcctggccagcgtggtgagaccctgtctctactaaaaatgcaaaaaaattaaccgggcatggtggcacgctcctgtggtccaagctactcgggaggccgaggcaggagaatcgcttgaacccaggaggcagaggttgcagtgagccaagatagcaccactgcactccagcctgggtgacagagcgagactccatcacaa

SEQ ID NO: 16822 - DNA, 504 bp, Homo sapiens
agtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtgggggtgggggggctgctaaacagacactgtacagagggagaagagacataatttagctgtgttgctagtatgattccatttttaaaggaggggagggggagagtctagagctctaactgtttttagttgcatatggaaatatctaaaaaaatatttagcatttttactaagtgcgttgaggcctctccagtgtcctcctggctgtggctgctttgtcattctctttgactagccagcc

SEQ ID NO: 16823 - DNA, 531 bp, Homo sapiens
acccgcccggaaagttggagcacaacgtcgaaagcagccgttgggagcccaggaggcggggcgcctgtgggagccgtggagggaactttcccagtccccgaggcggatccggtgttgcatccttggagcgagctgagagctcgaggtgagctgggctcgcggtcgcccctctcgcgcgccctctttaagaaccacggcgtccaacctccctggaaatggggggaacatggccgaggcgcgtggcgaggccgcctcgtggaggccccggagcggcatcctcagcgccccagcgatccggtgcccattaggtgcgccttgaagccgaggcaagctccttcggggtgctgggctgcgggcaaagaattcggccctgcgaagagttgggttcggcctgtctcaggcctgcccacatcccatcacagggccgtggacttgaagccggaacgtgaaatccctatagactgaatgcatttccttcctacctgttctctctccccttttatttttatttttatattattttatttttaa

SEQ ID NO: 16824 - DNA, 371 bp, Homo sapiens
gcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccstgkgaaggcgaggacgaggacgaggacgtcaagttagaagaacccgaagaacctaaagtgctaacaccagaagaacaattagcagataaactgcggctaaagaaakkacaggaagagtcagacctcgaakkagcaaaggaaacttttggtgttaataatgcagt

SEQ ID NO: 16825 - DNA, 405 bp, Homo sapiens
aggatgmcgtcagatacaaatatggcgttttggacgggctcgatagtttgcttggcctctactcaaggaawgctgatggtatagcaagaaggtattctgagcattatatcaatggggaagttmtagatcttttgcaaagcaggagctgccctgttgtgagctctccggtggagagccccacatggcaagaaaatgagaarccccctkmacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgac

SEQ ID NO: 16826 - DNA, 448 bp, Homo sapiens
agatacaaatatggcgttttggacgggctcgatagtttgcttggcctctactcaaggaawgctgatggtatagcaagaaggtattctgagcattatatcaatggggaagttatagatcttttgcaaagcaggagctgccctgttgtgagctctccggtggagasccccacatggcaagaaaatgagaagccccctkmacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgacctacagaggcagtgagataataaatgctgttgaggtcacaaaaaaaaaaaaaaa

SEQ ID NO: 16827 - DNA, 417 bp, Homo sapiens
aamaatraggatgmcgtcagatacaaatatggcgttttggacgggctcgatagtttgcttggcctctactcaaggaatgctgatggtatagcaagaaggtattctgagcattatatcaatggggaagttctagatcttttgcaaagcaggagcaagctgccctgttgtgaggctctccggtggagagccccacatggcaagaaaatgagaaaccccctgaacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgac

SEQ ID NO: 16828 - DNA, 558 bp, Homo sapiens
gtcatcctactttctttttcctggtattttcctctttgggactttggtttcattaatctcaatttgttctgaaggcactaaggcagattttcaaagagctgtaattgtcacagggagagcacaatgacttattgaagtttcacatgttgctctttttggaactaccagagattggaaccaattctccatccacatctctatccgagagttaagttttctcttctctggtgcttgtcaaaagtatttctcccagctaatctcattcccagttgccaaagaaaagatctcaagcataactcctcatctccaggtcacccgacaagatcttgcagttctacttctaagtatgtaatccagagaaaattctgacttgtgtataaaagaagactcattcaataatgtttatttcaaatgaacaaaaaagcagctgaaaaaaatcatgatatattcattgtatagcagtaagaatgaatgaagtaaacctgtatgtagtaacataggaagaaaaaagacgaatcaacatctcccttggaaaatactctagaccaaatttctgct

SEQ ID NO: 16829 - DNA, 476 bp, Homo sapiens
attaaagggaaagcgtgttgtgtgacatggagtcactgagtcattaacctagtcttatgggaatttggcttacaccttatttgtggtcttccaaccttttccttgtgtatcctttccttgtgtatcctctaaaataattttgtaccccctctcgcatagttgtctgaaatttttcatcttcaatttaaggaattgcaaagatctaatttctgttatattgtgtaaagtaagacagttagggctgggcacagtcactcacgcctgtagtcccagcactttgggaggccgaagtggacagatcacgaggtcaggagttccgagatcagcctgaccaatgtggtgaaacgcatctctgctgagaatacaaaaattagctgggcatggtaatgtgcacctgtagtcccagcaactcaggaggctggggcgggagaatcgcttgaacccaggaggcagaggttgcagtgagctgagatcgc

SEQ ID NO: 16830 - DNA, 450 bp, Homo sapiens
gagatagaattgcttttggtaagcttagcagagtcagagagaaaaggagagttcccagaaaacagaaagtggccaaatgattttctggtttccagaaaaggaaaaaaaacttaatttcagaatttacagataaaggaagagtctagtgtgcattattaaaattatagattgtgggccgagcacagtggctcatgcctgtaatcccagcactttgagaggccgaggcgggtggatcacctgaggtcgggagttcgagactagcctgaccaacatggagaaccccgtctctactaaaaatacaaaattagctgggcgtggtggcacatgcctgtaatcccagctactagggaggctgaggcgggagaatcgcttgaacctgggaggcagaggttgcattgaactgagattgtgccattgcactccagcctgggcaacaagagcaaaactccg

SEQ ID NO: 16831 - DNA, 310 bp, Homo sapiens
aaaaaaatcccaaacacctgctctctgaccctgactattgctttgctagcattacacatctwatggtttggctgtwaattcttcatcaccagcaccagagtccaggctggcaaagggctaggaaaccgatcatctgcctcctctamacccagaaccctgtgtggtgacccaaaacaaatggaaagaaccaacctcagatgaaatttgaacccaggtctgtagcctctgcctcctccacagtaggagtttgtgagaatgtccaccaataactgtttattaactaaattcctccacctttccaactcaaaaa

SEQ ID NO: 16832 - DNA, 349 bp, Homo sapiens
aaaaaaatcccaaacacctgctctmtgagccctgactattgctttgctagcattacacatcttatggtttggctgttaattcttcatcaccagcaccagagtccaggctggcaaagggctaggaaaccgatcatctgcctcctctacacccagaaccctgtgtggtgacccaaaacaaatggaaagaaccaacctcagatgaaatttgaacccaggtctgtagcctctgcctcctccacagtaggagtttgtgagaatgtccaccaataactgtttattaactaaattcctccacctttccaactcaaaaaaaaaaaaaaaaaaaaaaaaaaaaaaaaaaaaaaaaaaa

SEQ ID NO: 16833 - DNA, 140 bp, Homo sapiens
agagtttcaaaaggagatcatgaggcgtccaccttgcagtcatgatgtggaacctgctgacttctatttatttcctcgtattaaaaattctgcaaacggcaaaaaaaaaaaaaaaaaaaaaaaaaaaaaaaaaaaaaaaa

SEQ ID NO: 16834 - DNA, 141 bp, Homo sapiens
agagtttcaaaaggagatcatgaggcgtccaccttgcagtcatgatgtggaacctgctgacttctatttatttcctcgtattaaaaattctgcaaacggcaaaaaaaaaaaaaaaaaaaaaaaaaaaaaaaaaaaaaaaar

SEQ ID NO: 16835 - DNA, 291 bp, Homo sapiens
  misc_feature 34,116: n=a, g, c or t
aaaaaagcaggagccctccgtggcagtgcttggntgtccgggcgccgagactccggcctgacctctccatggggtcgaaaggacggtctctggatcccaggagtcgcggaggacgnaccagcatgaggaaaccattggcggaaaatggcaaaascaktgcgamatcccagcctcaactgccgggacgtgtttmaamaggcatttcaawttgtggcttggaytcacgcaaaggccccctcctggttccaaggtgttctatggatttycgttggcatcgatggaaaggtcact

SEQ ID NO: 16836 - DNA, 267 bp, Homo sapiens
gactaatgacatgcttgtcaggtgagtgtgcttttccctctcatgagttcgctgaattaaagggaaagcgtgttgtgtgacatggagtcactgagtcattaacctagtcttatgggaatttggcttacaccttatttgtggtcttccaaccttttccttgtgtatcctctaaaataattttgtaccccctctcgcatagttgtctgaaatttttcatcttcaatttaaggaattgcaaagatctaatttctgttatattgtgtaaar

SEQ ID NO: 16837 - DNA, 459 bp, Homo sapiens
agaaaccactccctggggcttggcaaagcaggagccctccgtggcagggcttcggtgtcggggctccgaggctccggcctgacttctccacggggtccacaggagcgtctccggatgccaggacctgaaatgggccgaccaggatgaggaacccacaggcagaagccggggaagcagcgcggcatcccatcctcaggcctgcccggacggtgttcggatttgatgttttgccattttaaagaatactagacaagaggatctcaatctggatcactatattgggctcctaatatcctgatataattttaaatcatcccaaacaacgcattattaccatatacatcagcatttcccaaactgtgctataagctatgtatactattgatatttttgagctaaaatatacttataaatacataaaaatatatttatctaggtggtgttatgcaataatgcmca

SEQ ID NO: 16838 - DNA, 268 bp, Homo sapiens
caaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctccaaaaaaaaaaaaaaaa

SEQ ID NO: 16839 - DNA, 526 bp, Homo sapiens
agatttgcttggggctggatcccccgcctaccgtttccccgcagccgccggcgcttctggcgcttgtgacccgagcaggaagcccagagagaaaccagaaagacaggaaggggattcctggacttcctttccacatccggcaggaacgcgaccctcctccagctaggagcgcttgtccgggcgcaccaagatgcctgcagcttcaagaagatgtatgggaacagacacagaaactttccctaccagataagcaggacaaagaaacacagactaagagttggcctgtgtggtcacggagtgggttaagagatgataaaaaaatctgctctgtacagatggcacacctggtcccaactaaaccctggggccctagaaagataagacatcccctcctcacaagcccctcctcaagagccccctcctcaagagcccatttataaaaactctgacattcttaactacaacttggcaatcttctcaggatccctctctaacagagacctgttctttcctttttgcctattaa

SEQ ID NO: 16840 - DNA, 515 bp, Homo sapiens
tttatattatttgattacaatgtattatttatggattttttattctttcctttataatgaatagttcgggtgcgttttgtttactcctaaaaggtttctttgcgtattttctaaatgtaatatctcggggaaaatataagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttmgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtc

SEQ ID NO: 16841 - DNA, 343 bp, Homo sapiens
tgaagaaaaggagcaggatactaggataattctgggtggtcttggggatggcagtatggaatctatacatatagagtagtcagagaaggcctcattgaggagttgttatttaatcagggacctgaagaattaagaggaggctagctagaaagaggataggtgagaaagagcatgatgcttttgacaagacataccaagactcctgtgattgaggcacagggaggaagggtgtaagacaggggtatccaatcttttggcttccctgggccacattggaagaagaaaaattttcttgggccacacattaaatacactaatgatagctgatgagctaaaagaaaaa

SEQ ID NO: 16842 - DNA, 460 bp, Homo sapiens
aaaaacaaaaaaaaacctttgttctgtaagacagtatagaaagttgggagaaaggtctactccaggatcaagacctcctgaaagggtctcgaggaccccaatggttcctggaccacactttgaaaactatggatctgaaaataatttaggattgcattttcctgtaatgccgcgtcttagcaatgtgaccttgggaactggaccaacaggacccaagggagagtatcaaaggcaaaacaaaggaaaatgaggacaacccaatactcagaaaaaaaaacgagtaattcatggattcacaacgggcaacaaactagatgactattaggaagagaagagcaaaccttatgatctcaaaatgatttcttgttcatttgcatcctcgcatcaatctagactttaagaaatatgkgatttttaaataaatgggtatatctgaaaaaaaaaaaaaaatgsgraaasc

SEQ ID NO: 16843 - DNA, 458 bp, Homo sapiens
  misc_feature 405,414: n=a, g, c or t
atttcccaactttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggagtggatcaaactagaactcatatnccatactanatatgtttgtcaataaacttatgacgcaaaaaaaaaaaaaaaaa

SEQ ID NO: 16844 - DNA, 459 bp, Homo sapiens
attttgggaccgacgaatgcgagcaagaggccaagcccctctccacctacactccgtagaaggcaggccccgaagccaggagacggcggagatcaccgacttccagagggtgcgtttctgcaaggtggtggcggcccctccgctgccgggggccgctcgctgaccgcgcccgccggaccgcggcctccgcgctctgcactaacctcccaccgcctcgctcctctgtcctctgcttctgccacactccagccaggagagggttaaatctaargagggaggagccagggtctgcgarccgggcggggccagggcagtagtcgggtgcaggccccaccaacgggggacgtcacggcactgggacggctgggacgcttccgcrttagtctcccatggaggccctgggcggctcgagccaggtcttcaggccgaatctcccgcctccaggattgcatccgaggc

SEQ ID NO: 16845 - DNA, 501 bp, Homo sapiens
aaaaggagccaacctggcctggtgaccttctctgtgcaagcagggagcaggcacacaccaccaatgagtgaagaaggctgctgtggcatgctcgggacctagagggaacctgcctcattgacaggggacagcagctgcacagctccagacaatcgttgtcaaggacgggaatgagattctaacatggctgatctgatttttcaagaaaggtgaaagacccaaattcatggaagagaagtgagtcacacagggagccagtggcagagccaaccccacagagcaatcaacatgctctactctgcagacctgcaacagggagggaagccagactctgatgcaagaaggaaagaccatgtgctggctcagtgtgtgcagcctggactgagctactgaactctaaatccaaggatgactaatgtaagcctaaagggtaatctgcaaatactgctccattaatattcaatgataaatgatattgctttagaatcaaattcacataaa

SEQ ID NO: 16846 - DNA, 471 bp, Homo sapiens
atatccagaaaaaaatgaaaacaagctattttggtcaagggcttatgaaatcatcatcattcttctttccttgaaatatcttttgcttctataataatgctgttggktcaatwaggtaaaataaaggagggtctttagtggtgtttatcttagcagtgtgtggggaaaatatcctccaaagttgaaataaccastgsrattcytycagaaaagtgatagccaagtgaggaaggcaatttgctagcttgacagacacctccctgagaacagtcaactccctggtctgatcacaagctacccaacaaacagggtactatctctgatgctctgcacctgccaggagggctgcccagtgaaggtggcccacctccactctctaggaaaatacatctccaactgcaaaatggcaaaccactgagtcattactggcctttaacaaaagtccggttagagggagctgcttctctagag

SEQ ID NO: 16847 - DNA, 197 bp, Homo sapiens
attccgcgtgcgtaatggcggcttaggagcacgccagacgaagccggasagcggaggcggggtgctgaagggagacgggatggcgggtgtacatctctgccgagttccgtactcttgggcatttttgtggcccaatccagcctaaagcagggttgagatgacggttttcgcgttgmmyttctcggagctgcccgccg

SEQ ID NO: 16848 - DNA, 432 bp, Homo sapiens
agaacctcccgccatattcctctcacctccatcgacctctgccctaccagcgtgasktggagatgtcctctacttacccactagctctcaagaccatacctggttcacagacaactgccaagagacctgcggtgaaccaaccagctgccagccggtccactgtgagaccggcaatcttgaaacctcttgcggttcttccactgcttactacgtgcccaggccttgccaaggaagcagttttcttcctgcttctttcttctccagttcctgccttccagtatcctgtagaccacagaggtatgtgtccagcggctgtcgtccactgaggccgctgctcaatagttascagcccataggagactgtgtgcccaatgcctatcgccccaattctgcttgktcaagagttgccagccccaaaacctcctcacttct

SEQ ID NO: 16849 - DNA, 495 bp, Homo sapiens
agagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtc

SEQ ID NO: 16850 - DNA, 429 bp, Homo sapiens
accattttcccatgaatgacatcataatagaacctccctgtcttattgccttttcttattggtaacaaaagatgacaaactaggtaatttatattaaaaagtttatttagctcatagttctagaggctggaagtccacagtgccggcatctgtgagggccttcttgctgcctcacctcatggcagagggcatcacatgctcagagtgggagcaagggagccagggagagctcacaggcacaagaataacgctgctgtgataataaacccactcctgggacagcaacattcatcccgtcatgagaacagagccctcattcatycattcatctcatcataggggcagaargattacatttctaacacatgaacttttgggggacacattcaatacctagcactcccaaaatattcactaagagtgagagta

SEQ ID NO: 16851 - DNA, 843 bp, Homo sapiens
  misc_feature 492: n=a, g, c or t
tcgacgacggctggagggacgtttcagaggcgagtcctgggtggctcctcgccttgggggcctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagvangttgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggattgagcagctccgttctgtcagatgctactccaaatgttaccagaacgatgacaaaagtgggagacgctcta

SEQ ID NO: 16852 - DNA, 449 bp, Homo sapiens
  misc_feature 423: n=a, g, c or t
agtcagccattatgataactatgcttcttacacctgagaagagggacatatttcaaactttctggctatcattttgaagaactacaggattcctaaggcagtcagtccaaagaataaatgatcagaaaagacagagaacgaagaaatcctctacgagccccatgggttcacagaagtctatcaatcactctgtcagtcttccggatcataattcaagttgccttccccaattttgttggatatatcagatctactccagctccatgggatgatcagtgtgcttttttcctatttttaaagacagcaaagtggaaaactggtggatattataaggacaccctaaaaagtacmbtgttactatgacaatgaaaaggagagcaaatgtccaaactcttcttggtaaattccatttttctgtttganatattttagttccctgcattaagtgt

SEQ ID NO: 16853 - DNA, 175 bp, Homo sapiens
tttttcttcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagccacccaaaatc

SEQ ID NO: 16854 - DNA, 409 bp, Homo sapiens
ctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttctgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaactttttttgagta

SEQ ID NO: 16855 - DNA, 517 bp, Homo sapiens
  misc_feature 475: n=a, g, c or t
gtcccggcggctttacaaagcccgcgccasctcggccgcccggcgggacccagagccgccgcggagcttccagcgtccccaggttttataataatcaagaagcacatgaaagaggcctcttcatcaagcattcttgactaagttatgaaaatggaattgaagtttattttcccccttcatatggtaagtccagctgtgagcagagtgttctgttcttcacttccagcaagccaggtcagtgtctttgtgcaaacccatgactatagattggtaacatcctgtgtctaattttgagcatgcatttcagaacaggtttcttaatcatttgtcttttaaaaattttgtctttgacttttttatggactcagttatgaatgtcataagttcaatgattattaaaattattgcttactctgggagtacaatggtacaaatatgggcctcaaaccagtttgtccatcatacgactttttanttttcactttaggcatcagagtggtgcccgtggtgagatact

SEQ ID NO: 16856 - DNA, 275 bp, Homo sapiens
gcattctgaattatttttctaagctctcatatctgcagtaaagatttggtttatttttataaacgaataagagatatatggttagaatgatatgttccaagtcttaatatccgtaacttagtgcaatttagtttgcaacataacatcttggtcctactgtggaaaaggagctctagatttgagcactgaatattttgtaagattttgtgaatttgcaggaccttgactttattcaaatgtgttccaaaattcataagttttttttcttttttttt

SEQ ID NO: 16857 - DNA, 478 bp, Homo sapiens
ttcatgggattcatatgaggaacaaaattaaatttgaatacagtcagataactgccacgcrggcatttggggaacatccccgaatgccctgatgtgatttccctcagaaaatccttgttattagaggagaaggtctgggcaggggcagcagcatctcagacatcaagtcaactttatcatctactacatcagcactgaagtccaggggcattgaggcactaactaggttccattttctttggtttggttacttattttttctttttgggttctcggtgtgcagaggctgtagagagagcctcagggcgtgaccgctgcaggaattcggccctccagctcccctccagttaccaggagccgatttggaggccaggccttcccagctgagtgtctgtcagcttcattctctctcagctgtgcagtggaagagcaacaacagacaggtgaccttcttgggttgtgcttcacaatggactgg

SEQ ID NO: 16858 - DNA, 418 bp, Homo sapiens
aggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttcctagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtg

SEQ ID NO: 16859 - DNA, 436 bp, Homo sapiens
cagattaccttagttattgcgctacccacagtaggacaatattgtaaagcataagagaacctctgaatctgattataaatgaaatagagattacttagaggttatttcttgtctatattgttaatatagaataagagttgactaggtagtcttacatttaaaaatccctgttgtggccaggcatgcgtggtaggccaaggtgggaggatcgcttgagcccaggagttaaagaccagcctgggcaacatggcaaaaccccatctctacaaaaaattagccagatgtagtggcatgcgcctgtggtcccaaccactcaggaggctgaggtgggagaatcgctgagcccgagaggcagaggttgcagtgagccaagattgtgccactgcactccagcctggctgacagagcaagaccctgttcaaaaaaaaaaaaaaaa

SEQ ID NO: 16860 - DNA, 419 bp, Homo sapiens
  misc_feature 367,386: n=a, g, c or t
gaaatacaggtttgctgggtgtggtggctcacgcctgtaatcccagcactttgggaggcctaggtgggcgggtcaccagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaaaatacaggtttgcagggaggccctgtgggtggggaagcatgggcaaagcattctctcctaatgtngcatgtwaggtagaatgcngcatcttggtcattcttccctttcatcgtttga

SEQ ID NO: 16861 - DNA, 445 bp, Homo sapiens
  misc_feature 417: n=a, g, c or t
acccggaagcgcgcccgggctcctgcaggcggggcgctgtgcggccgcgatccgcatttgcaggaccagggatgctgtgctgctctcccatgagccagtcaccgagtcggtctgctgaagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagaggttggcctcttgatgctctgagctcggtgaccccacccccacaccccaccagtcctctctggactaaatgagggcaagaagaagtcgaattttatcacgtaacagaagaacttggagccatcagtttctgtnacctaaaaagtttaacaaggctggggcg

SEQ ID NO: 16862 - DNA, 284 bp, Homo sapiens
agttgttacttaggtgcgctasctgcggasccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacgaccaamtcatamasctcctatggaaaaaactycstaccahtcaccctagcattabdatatgscatgtctccatacccattacaatctccagcattccccctcaaa

SEQ ID NO: 16863 - DNA, 430 bp, Homo sapiens
  misc_feature 413: n=a, g, c or t
taaggctcattctgggttttctgggcaatgaactaactagaactgagagttcctccttcctgtagtggtaggagagtgatggcattttccccccaatactggagatggtccttcccacagactttctgtttccaagctgcttgagcagttgggtttcctagataactcttctaaagcattggcacccacatccagacttcttggggtgccaggcagcccgtgcctgcccccattgagaagtttgcatcactatgctcatcccacaggaggccagattaccatggggacttgcccttccagagcaatagcctggccctagcttgcctccctgtgtgatgatgggagagaaggggactgcctttggtatagtgggttttctttttctccaataaagtctttttctcaagcaaaanawaaaaaawwtgcgaaa

SEQ ID NO: 16864 - DNA, 436 bp, Homo sapiens
agtgacaatcaggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcgacatgcagcgggcccactataagacggactggcaccgctacaacctgcggcggaaggtggccagcatggcccagtgaccgccgagggcttccaggagcgagtgcgggcgcacgggccgtcgcggaggaggagascaagggctcggccacctactgcaccgtttgcagtaagaagtttgcctctttcaacgcctacgagaaccacctcaagtcccggcgtcacagttgagctggagaagaaggccgtgcaggca

SEQ ID NO: 16865 - DNA, 400 bp, Homo sapiens
tcaattagtttttgacaagttaataaaacagaaaaatgaaaagacatacaaagtccaagtcaaaactttttatcgttagagttaacagccataaaattacctgcaaaattgacatagagttttctactctctctctgtgaacgatttgcaaacagttctcagaagagcccaggtctatagaccatggttagagtactcaaggtaaactactcaaattagaccatactcagctgtagagtttcaaccaaatgagatttgtttggagaacatcatagtctctctcagttgggcgtgctggctcatgactgtaatcccagcactttgagaggccgagtcggtagatcgccagacctcagggcaacatggcgagaccccatctcttaaaaaaaaaaaaaaaaag

SEQ ID NO: 16866 - DNA, 302 bp, Homo sapiens
tacaaatcaagaccagccagatgaagagacacttagggcaaagtttgagaggatcctggatatggggcttccctgtccttgctctgtgggatcaatatgtgttttcttcctggcacattggtgcaatcatcaaccagggatctccaccaatctttggtatccagagtttttattggggtttcattatgtaggcatgattgattgactcattggtgatgtgattgttcaatctccagccccctctcttcactcatgaaaccccaataaatatcctcattgacaaccaaaaaaaaaaaaaaaaa

SEQ ID NO: 16867 - DNA, 156 bp, Homo sapiens
gcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacattttta

SEQ ID NO: 16868 - DNA, 122 bp, Homo sapiens
gactgtccccctcaccaggtccgtggccttggcatcactcaacctggcccagcctcagagtcagtgcttgtctctgaacaattagggccgcgtggggggctaatatttaggacacgaataaa

SEQ ID NO: 16869 - DNA, 156 bp, Homo sapiens
gactgtccccctcaccaggtccgtggccttggcatcactcaacctggcccagcctcagagtcagtgcttgtytctgaacaattagggccgcgtggggggctaatatttaggacacgaataaaataatgtatamcgcttaaaaaaaaaaaaaaaaaa

SEQ ID NO: 16870 - DNA, 168 bp, Homo sapiens
gactgtccccctcaccaggtccgtggccttggcatcactcaacctggcccagcctcagagtcagtgcttgtctctgaacaattagggccgcgtggggggctaatatttaggacacgaataaaataatgtataacgcttaaaaaaaaaaaaaaaaaaaaaaaaaaaaar

SEQ ID NO: 16871 - DNA, 182 bp, Homo sapiens
gactgtccccctcaccaggtccgtggccttggccatcactcaacctggcccagcctcagagtcagtgcttgtctctgaacaattagggccgcgtggggggctaatatttaggacacgaataaaataatgtataacgcttaaaaaaaaaaaaaaaaaaaaaaaaaaaaaaaaaaaaaaaaaaa

SEQ ID NO: 16872 - DNA, 179 bp, Homo sapiens
gactgtccccctcaccaggtccgtggccttggcatcactcaacctggcccagcctcagagtcagtgcttgtctctgaacaattagggccgcgtggggggctaatatttaggacacgaataaaataatgtataacgcttaaaaaaaaaaaaaaaaaaaaaaaaaaaaaaaaaaaaaaaaa

SEQ ID NO: 16873 - DNA, 233 bp, Homo sapiens
agtaaccaatacaggactcctgtagtgggcagcctgggtaagacttcactggtgctgtacaacactcttcaactcttcttaaacaatctccctttcttccctcaaatgtcagccttgcattatggtatgaaggttttccctaactactaaagttttgctggcatttttggcaataaatcttttacatttctaattaaaaaaaaaaaaaaaaaaaaaaaaaaaaaaaaaaaaad

SEQ ID NO: 16874 - DNA, 461 bp, Homo sapiens
tagatataggcaggtcaggtcccaaaccccaatgtaatataggctccctctttcacactctgtcaatggcacaaagccctattgttaatacagttctctactcacactcaagataagagtaaacaacactgtccttcgactacacaactttcttcctctacacacatctgctctgacagctttcctccaggcgtctcatcacagcaatactgaaagggactgtggcaagccagttttgggacccgtcctccaggattctgggaagatgaggtggcctacaggaccaagagaccaaagctatatcgagaaccagagttccctctgttgccagtgtcagtaaggaattcctccatgggagttccacacttgaatagagctagctgatcacagaagagaaggtcagagagatgcattcaggccggcctggaaaaaagcaaacattcatattgggaactaccact

SEQ ID NO: 16875 - DNA, 237 bp, Homo sapiens
acgcacctcggtaacatcacagcaggtccaggccaatgataaccttataagaggccatgtcgaagcgcgacatcgtcctcaccaatgtcaccgttgtccagttgctgcgacascgtgcccggtgaccagagcaccgcccccacctgagcctaaggctgaagtagagccccagccacaaccagagcccacaccagtcagggaggaaataaagccaccaccgccaccactgcctcctca

SEQ ID NO: 16876 - DNA, 474 bp, Homo sapiens
agaaagccagacttgagggagctgggcctggtgccaccagcttaaccacagcacacactgcaactcattcatacgagaaacacacgaaatgtaggctgtgttgagaaataaatagcagaattgtaattaggggccagaggaaaagggtgtgaagaccatgtcaagatttatgcctgtgagatgggttgcagaattgacctgagcagaccaggcttccgagggtcaaaaaagcgtctgaaggagagacactgagtgcattctgggttcacattcccctcctctactgcattcctgaattttctgcctcacagcggcatctgaagcagtggctgtatgtgtccttaaccacccttcaagtccacaacatgtcatattacctcattttggctccctgggactattttggaggacctgaattagtcatgtggggtacttgattaaaaatcacttgaacagccaaaaaaaaaaaaaaat

SEQ ID NO: 16877 - DNA, 454 bp, Homo sapiens
aatgcgcaagaaggtgcctgcgggactggagcagagcgtgctgcgagggtcttcccagcgcaggcgggttttccagtgttacttgcggctgggcgtgggggactagctgcctttctggcagcaggcaggaagccgcaaaaagtttctgagcccccgaacctgtagcggacgtggaaaaagaacgcccctcctcaagtgtctggctgaaagatgccacccagggaagggaactcgggctagctaaggaggccattcttgatgttgcttctagatctcatgtcatcaccgagccctcagctgctggtggcagctgctcagcagacccttggcatgggaaagagacggagtccaccccaagccatctgccttcacttagctggagaggtgctggctgtggccggggactgaagccagctgtgctctatgattgcaactgtgcaggggcatcagagct

SEQ ID NO: 16878 - DNA, 583 bp, Homo sapiens
atacagattctctctctgcatcatgaggggctgctgtctggggatgggggaagagtggtgtaggcaattcaagtctgcctttcctatcctcttcagtgcctctttccttaatatgatgtggagaaataggaacacttttacactgttggtgggactgtaaactagttcaaccattgtgggaagacagtgtggctattcctcaaggatctagaactagaaataccatttgacccagccgtcccattactgggtatatacccaaaggattataaatcatgctactatgaagacacatgcacacgtatgtttattgcggcactattcacaatagcaaagacttggaaccaacccaaatgtccaacaatgatagactggattaagaaaatgtggcacatatatgccatggaatactatgcagccataaaaaaggatgatttcatgtcctttgtagggacatggatgaagctggaaaccatcattctcagcaaactatcgcaaggacaaaaaaccaaacaccgcatgttctcactcatagcaatctctatctgtgaacctgtagtcaattcagagtcccaaactggtt

SEQ ID NO: 16879 - DNA, 209 bp, Homo sapiens
agtaaccaatacaggactcctgtagtgggcagcctgggtaagacttcactggtgctgtacaacactcttcaactcttcttaaacaatctccctttcttccctcaaatgtcagccttgcattatggtatgaaggttttccctaactactaaagttttgctggcatttttggcaataaatcttttacatttctaattaaaaaaaaaaaaaw

SEQ ID NO: 16880 - DNA, 548 bp, Homo sapiens
actctcgcgaggccccagagagcaggcgctgggcagtgtggaggtcgttggagtcacttccgcgtcaccagctcctgtgcctgccaagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagcccyttgtgagccgcctgaccctctatgatatcgcgcacacacccggagtggccgcagatctgagccacatcgagaccaaagccgctgtgaaaggctacctcggacctgaacagctgcctgactgcctgaaagttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattcca

SEQ ID NO: 16881 - DNA, 602 bp, Homo sapiens
atcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaacagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagcatccagggcaccctgactgcagagcakttggagcgcgagttacagttgagacccctggcaggagataggaccagctgtgctgtcatgcagcta

SEQ ID NO: 16882 - DNA, 424 bp, Homo sapiens
cttgaggagagcctctgtctgcagaggggagacgaataggacacaggcaggtctgggagtgtcttgcagagccgaggaggtgggtagcagctggcctgtggagaaagccagtcctagtgacagccttccctccctgaccaagccccctctccattcctaggcatagaaggtccttcctgaccctggcaaccccccctgggacggacctagcttgctctacttctgcaagaggaaagccgttatctggggccaatgcgtcccactggcttgatttcaagagtggcagaagcctgatggaagggtccttgagtgaatcctcccagccccccgaatgaggccaggtagatgcagtgagctgggctatccatgtcgcagcctgkcargaggggagcaggatccttttcctttctggggcctstgggac

SEQ ID NO: 16883 - DNA, 313 bp, Homo sapiens
aacctgtgaatttgctccatcaagactggcaggcagggttacccctgaggagggggtgggggagaaggggtaggggtgggaccctatcatctcccagagggagatcaaggcagccatcatctgtcgaactagatggtcccaggaaggtggcgtcasatctgcagccgcgtcgacgttgtcggagcctccgcggaggacccaggagagccggactaggaccagggccctgggctccccacactccccatggagaagctggcggcctcgacagagccccaataaacgatcccacagcctcaaaaaaaaaaaaaaa

SEQ ID NO: 16884 - DNA, 482 bp, Homo sapiens
aaccctctctcttctccttctttgctgtcctgccggggatctccagtgtgtgcgggggcttaaggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggccaggggctggcctctttgccccattcccgctccatgccggccagagtgtagaaagccataacgcagccatcagcacaataatgtgactctacgctgatatgctccctctctcctccactgacttccccttcccggatttgtgaggtgtcaagactaggaatctggccttagagcctgcccctccaccccctcagatcaggcatagcatagtcaagcccagcaggtttcctcargagctgtctggggtgtt

SEQ ID NO: 16885 - DNA, 514 bp, Homo sapiens
atttacaacaaaacttggtgagaagatatccctgcaaactcccagatccacaaagacctgcatggtactaacatctgtgcaggagaaagcacaggggctttctctgtgggacttctgatggatctgagaacaagagaatccccaaatagtcaacagtcgttcactggaaagcatggcaggccaagctgaggacagcatttgtaactgggaagaggtttgccaactccaatagcagagatggagttcactatgtttcccaggccggtcttgaactctcgggctcaatcaaaggagtagaaacaatgcaaatggcaacatgagggctgaactctggcacagarcttttagaagaaagaagaaactaaattcctatgataaaggcgacacacagctctaggtaatgaaagaagtaagcttgacctcctgatgccagtatacttcctamtgtactaagatgaagacctatgaatccagcctgcagatcaagagggctgaataggccaggtgtggttgg

SEQ ID NO: 16886 - DNA, 470 bp, Homo sapiens
tttcccgagccggctccgtgtttagggagggcagtgatcacgcaagccggagcgcgggctgacgttggacgagctgccaggtagctgaaasaggcagccaggcagccgagacacttcccagcgrttccagcctgggctccgcagaagcctcgctgaatcccagccagctggttctaaccttccagaatcgcaatcccttctccccacagccagccctcgccaagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttcsgsggaacgtgacggcgaccg

SEQ ID NO: 16887 - DNA, 602 bp, Homo sapiens
cagatttcattagttatacagatactcatttgtgtgtgtgtgtttgtgtatagctgtatgcaatgttatcatgagtagctttgtatacaccaccaccacaatctagatgcctaactgtaccgtcacctcaagactccttatgctacccctttatagatacccactcccttcagtcccccacatccctaaccttccccagaagccacgaatctgttcatctctataattttattcatgaaattaataataataattcaataaattgaattatgccatatgtatcttttggggattggcttctttcactcagtataatttccttgatgttcatctaagttgttgcatttatcaatagtttttttctttttattgctgagtagggttccatggtactgatgtttaaccattcagtcactgaaagaaatgtgcagtttccggatttagttattacaaataaagtactataaatatttgtacaagtgttcctgcatgaaaatcagttttaatttctctgggatatatgcccaggagcacaattgctgaattgtatggtgatatggtttgactcagatctcatcttgaatttccacatgttgtgggag

SEQ ID NO: 16888 - DNA, 169 bp, Homo sapiens
agcacttgttcgcwggccgcccctggaggctagaagctccggcgccgagagtgggcatggcgacttggtctcagccrgactcgggtttctctggaaacccccctggtaagtgtggaggaggcgggacactctgacccaagacgaaaggcctgtagctccagccaaagaa

SEQ ID NO: 16889 - DNA, 342 bp, Homo sapiens
attcttagataatgaagctgtggcagtaggaatgtatgtgaggcaacctgccagggtaatgagatgaagaaacaaataaaatgtaaaggctacagaatgaagaagcaatactgtctgtgcctgtaaacccccgtcacctgatggaatggatgtctgccctatatctcagggctttgttataaactcaaatgaaaggatatttatgaaagaacagtatgaactaaactacaaacrcaagaacgctgaatctcccggactggccctctggactcgaatatcagcacttgggggtgaatgaagaaggtgcatcatttccagggaagcagatttgctgttgactaa

SEQ ID NO: 16890 - DNA, 431 bp, Homo sapiens
ggtcagtggttccgggtaggagctaggtgaccctcggctgctgcagggatctgcagsgactgcagccatgggggcgcacctggtccggcgctacctgggcgatgcctcggtggagcccgaccccctgcagatgccaaccttcccgccagactacggcttccccgaacgcaaggagcgcgagatggtggccacacagcaggagatgatggacgcgcastgaggctccagctgcgggwctactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggaggaaggctgctccagcggaagaagckgcgggakaagaaggcggcagagttg

SEQ ID NO: 16891 - DNA, 157 bp, Homo sapiens
agagcatggcggcgggcgagcttgagggtggcaaacccctgagcgggctgctgaatgcgctggcccaggacactttccacgggtaccccggcatcacagaggagctgctacggagccagctatatccagaggtgcgaaaaaaaaaaaaaaatgcgaa

SEQ ID NO: 16892 - DNA, 405 bp, Homo sapiens
catatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaatcagtttttgttcttaaaaatgcatttaagttgkaaacgtctttttaagcctttgaagtgcctctgattctatgtaacttgttgcagactggtgttaatgagtatatgtaasagtttaaaaaaaaagttggtattttataagcacagacaattctaatggtaacttttgtagtcttatgaatagacataaattgtaatttgggaacataaaaactactgaataaatcatgtggc

SEQ ID NO: 16893 - DNA, 432 bp, Homo sapiens
aagccgcggttcctaccaaccgttcttattgctggcggcctgaggagcccatcatggcgacgcccctaagcggcgggcggtggaggccactggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtgatgtgagtgtctacccgsccctctgagcccacagggttcagcttaccccttmcctcatgcaacttatatttttttgagtatcttctatgtaccaggcactatgcgaggttttatatccagtaggatatcagcta

SEQ ID NO: 16894 - DNA, 513 bp, Homo sapiens
aaaaagaggaaaggagcggggagcggggaaatgctatgtgggcctgtttggatcttaactgaaataaaccgactgtagaaaggcattatttttgggaaacccgaggatggactcgctattagatgatattaaggaattgtagttaatctcgtcgcgtgtatctgttaagggctataggctgaagtatttaatgctgaaaccatatgatggtttctttaaaatacccccaaccggccgggcgctgtgactcaaacctgtaatcccagcacttgggaagccgaagcgggaggatcgcttgagcccaggagttcgagaccascctgagcaamatagtgagacctcgtctgtacaaaaawtkttttttaattatttatttaattaaattagcttggcgtggccgctcacaccttagtcccagctacttgggaagctaacgctggaagatcgctcgaacccaggaggtcgaagctgcagtggggccatgaccctgccactgactccagcctgggtgac

SEQ ID NO: 16895 - DNA, 496 bp, Homo sapiens
aaccttggaagactttatcagtcaatgagaaaatttaaggtagaaacatgtttttactatatttttctctcttaagtaatgaaatagaacctgaaataataaattttaagtaagctcaaattatacacttattgcacaaaggaattgagaagatagtgagtataaaacaacataggccaagcacagtggctcattcctataatcctggcactctgggaggctgaaatgggagggtcctttgagaccaggagtttcagaccagcctggacaacatagggagaccctgtctctacaaaaattaggcaggtgtggtggcacatgcctgtcttcctacctacttggaagactaaggcaggaggatgggttgagcccaagaagttggggctgcagtgactatgatcacatcactgccctctagcctgggtgacagagtgagacctatctctaaaacaaacaaacaatagtcaraatataaataaaatttaaaaatcaggag

SEQ ID NO: 16896 - DNA, 561 bp, Homo sapiens
tgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagt

SEQ ID NO: 16897 - DNA, 347 bp, Homo sapiens
  misc_feature 2: n=a, g, c or t
tnctgggagagttcagcacctcccggcaggaagaggctccggcctcattgggtgcgtkagaagggaagggtggatcctaaaaggtaatactgagccttcattcaaactaaaaggctggaagggaggcagctgcctttgtttgccatggatgggtaggggctgcactgagcagcaccggtgttcttcatccggctgcacccccaacagagctctttcttccccagatcccttttacagttggattctccctcttggatctggctctgcttagtccgrcctagagggatcagcttcgcccacgcccactctcacccggaacctttcatctcttattgaagccttttagg

SEQ ID NO: 16898 - DNA, 540 bp, Homo sapiens
gatcacgtgacttgcttgaccttatcaatcacttggacaactcaccctccttaccctgccccctagtcttgtattcaacaagtatcagcacgcccagccatttggggccaatactgtttctgcgtcttggtggtagtggtccccccggcccagctgttttctccttagctctttgtcttgtgtctttatttcttacaatctctggtctccgtacacggggagaaacccgcaaagccctgtaggstggaccctacaatggatctgttgtaatttttgcctgaaagcctacctctttttcagctctttcctattttatcagagaaaagagtctaaaattctcattgggccaagcatgttgtttcttcgtttaaaagtttatgtagacccttaggtattatttcatcagtgctgaagatggacacttagaaacagtgttgataacttccagccctactgaaatacctgcaaatgcctataacattatgattgtttgctttctcctgaaagaggctttaaacttgttcgataaatttaaacatt

SEQ ID NO: 16899 - DNA, 473 bp, Homo sapiens
attcagctgggagcatccgcagactcacgtctccaaaaaccaagctctccgagtgagcaattcctgtccctcttaagggcttacaactctaagggggtccgcgtgagagggtcttgatggattgaggaagcataggccctcctctgtgtggagtctctcgctggacctaggaactcagggatcctaggcaggtcagctggaagggaagacacgcctctccacaccaagcctgaggttcaccgcgaaagagaggccgccaccctgccccaaacccgccccaacctgctcctccagcagagccctgtgttcttcctggctgaggagtggttccagcaaagcggggctcttccacgtccttcagctccccccagtggcgccggatctaggaaaggttgtgccttttgctgaaactctggggttgacaggagctcatctaacaggctggaggtgagtgcagaggagagcccggctcc

SEQ ID NO: 16900 - DNA, 681 bp, Homo sapiens
  misc_feature 520,564,665: n=a, g, c or t
atgctcaggaatgctttcttgtcattgttgacagccctcctctgtgtggagtctctcgctggacctggaactcagggatcctaggcaggtcagctggaagggaagacacgcctctccacaccaagcctgaggttcaccgcgaaagagaggccgccaccctgccccawacccgccccaacctgctcctccagcagagccctgtgttcttcctggctgaggagtggttccagcaaagcgggctcttccacgtccttcagctcccccagtggcgccggatctaggaaaggttgtgccttttgctgaaactctggggttgacaggagctcatctaacaggctggaggtgagtgcagaggagagccccggctcctggagcggttgggaggtgcccggttggctggcatctgtgcttgacgcggaggcctccggggtcacgagctccggaggtgaaggtgccccgtcttcgggttcccatgccgccctggcgacctgcggctccaggcccaccacggactccggtnggacgtgggtggcgcaasacacctttcccctgtgactcagcttnaggggccccaaggtgtcccactgagcacgcgcccagcaggccatcgcgctgcgggttctggtcttcctgtcatttgttggggttcggaggccaccagggantctgaggatgggagat

SEQ ID NO: 16901 - DNA, 368 bp, Homo sapiens
atatccgggttcccgccgcctccaccgccaccgcctcagccgcctcgcacatttagtcttgccgggagtggtgtgattcccgaccaagattggcggccgttgggggcgagtcggctccttcggttcttctccgccgggaattatcctcgacttacactgggcggccccttgggcaacgagatagcgtcgggcaacggtggcgccgywggcaggcgaacgacgaggacgggcagaacctttggtcctgcatcctcagcgaggtctccacccgctcgcgcttccaagctccctgcggggaagaacgtgctactgctgggtgaagatggagctggaaaaacaagcttaataagaaaaattcagggaataga

SEQ ID NO: 16902 - DNA, 576 bp, Homo sapiens
atattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaatacttgaggttttatgtcagatctaatcttaagtgtttgttgttttttaaaaggtgttttctcagatggctgcagtgtttttgctatttctgcataaatac

SEQ ID NO: 16903 - DNA, 366 bp, Homo sapiens
agttgaggccaccctggtggcaccaaagccctctcaggcaggcagacccagggcctccccgccacaccttgttcatggattttgtcgcaggagccatcggaggcgtctgcggtgttgctgtgggctaccccctggacacggtgaagggcctgctggccttgccctaggcctggagccgctcgtgcctgaagcccaattctcctgcaggtcaggatccagacggagccaaagtacacaggcatctggcactgcgtccgggatacgtatcaccgagagcgcgtgtggggcttctaccggggcctctcgctgsccgtgtgcacggtgtccctggtatcttccgtgtcttttggcacctaccgscactgg

SEQ ID NO: 16904 - DNA, 456 bp, Homo sapiens
  misc_feature 205: n=a, g, c or t
attgtgcggccgccgcscgctgcggagggttgggggaggagttgggagtttagcgcagtcgccggagtgcgaggacaacgaccatccggccctagcctggccgggcgggtgcgggagcttccctttctcagcgcggcgcgaaggtggctcgccgtcagcgcctgcttccctcgacctcgtcctcctccccgctccggaggmvtgncgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcagagaacgagtccctcttcactttcctcggcaagaatgtgtgactatgtcttcagcagtgg

SEQ ID NO: 16905 - DNA, 527 bp, Homo sapiens
gctttgacaaaaccagggaaagagacagagagagataatggcggctaaactaatctgttcgtctttaacagtgcattcaatggcaaataagaagccatcaccttctgctgcaacaagaacaataacctcaaagaagagcacagcactccacaggtgaaactgctgacaagagtcgagcagctcaagcttctgaccaaagccgagaaagcaggacttttgtctttagcagagaaatcaggtttctctctatcgaccatcgagcgtcttggattgctgaccaaagcagaggagttcggcgttttgtctgccgccacaaacccggaaacgcctggaacgttattcactttgagcctcggtttactccttcttggaccggtttttgcatatgtggttcctgaagattacacttgggaagtagtgattcaggttcttgtggctctactctctgttcttggtggctctgctgcttttgctgcttctggttttgtctccaatttgcagaaatctgattagcccgatcgtttttt

SEQ ID NO: 16906 - DNA, 431 bp, Homo sapiens
gtcgaggcggggcgcgggaacgacggcggccatggcggcctcggggccgggtgtcgcagctggtgcttgtgtcccgaggtgccatccgccaccttcttcactgctctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctgggcgctttgctggcaatttcgagagaaccgtgggcaccgtccgccactgcttcttcaccgtgatcttcgccatcttctccgctatcatcttcctgtcattcgagactgtgtcatcactgtcaaagctggggggaagtggaggatgccaga

SEQ ID NO: 16907 - DNA, 451 bp, Homo sapiens
aacgcaaacccggaagcggatcgggtggagtgtaggtcatatcgccgcgttgactagataacgaaggrcaatgcatatatacaaaattgctgtattgcctggtgatatgcaactgtacctgtgacatcataattgcaccctccgacatgatatctcttccaaatgcttgatgaaaaaggtgggaggatcacttgagccagggagttgaaggctgcagtgagccctgtttttgccaccacactccagcttgggwgagtgagctacaccctatctcaaacagacaaggaagtaaatgagaggtttaattcctcctttgaaaataaagaaagagattttctttcctttcatttcttttcttaggagatttatttagaaaatttgcaaatgcattttctgttttctgagggtagtattctttctttctcttttcttttctttctcgcacatggaa

SEQ ID NO: 16908 - DNA, 449 bp, Homo sapiens
gagccggcactgatgttttctggggtcaccagaaagccctggtttcaccacaaattgtgactgtcaggacacagtgctgctatggtcaggattcctttccatatgctgcttcagcctcagacctcggtgggccttaagagtaggggctgctcagccaggcgcagtggctcacgcctgtaatcccagcactttgggaggcagaggcgggtgggtcacctgaggtcgggagatcgagaccagcctgaccaatatggagaaaccctgtctctactaaatatacaaaattagccgggtgtggtggcatgtgcctgtaatcccagctacttaggaggctgaggcaggagaatcgcttgaacccaggaggcggaggttgcggtgagccaagatcgcaccattgcactccagcctgggcaacaagagcgaaactccgtctcaaaaaaaaaaaaaaa

SEQ ID NO: 16909 - DNA, 349 bp, Homo sapiens
gttgtctctttttcttcctgcccctttgtttgacttcaccattctctgtttccttttcgctccgctgtagttacgtgactcacctttcattcagtacctcccttcaaggaaagccctgtctcctgtccttggactgggatcacacagagttcttgggatgaccctggctctcccgcgccagccgctctgctgccaagcgcaagcattcgctcccagatgcttcgcccagttctttgcaaatgtcatccaatcagtgtccaggtgttcacggctcatcactggcttactgctctggtctacatagcttgggacattgctgtttatgcaggtataaaaaaaaaaaaaaaaa

SEQ ID NO: 16910 - DNA, 216 bp, Homo sapiens
cagcggaasracgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtct

SEQ ID NO: 16911 - DNA, 435 bp, Homo sapiens
aaaggtggwcagacaccccagcacaaagccgagtgaagaactctgaggaaggatgcgtgcttgsrgaatgatgcctcgaccctggtgcctgaagccgwgcctggrratctgaagggagccgagctccttctgcagaagggcgctgagaagggagctggaaggaaaagaaggaaacattccttcctcaactggaggaagacacgcggccacacacagaaccagcggccccaggaccgtcaccctgcgtgcccgggcctgtccctcctgaccccaggattatagtggcgaggcagggtgttagccaagcggattgagccaggacacagcaccgcggascctgcaggcgagtcctccggagctgagagcaaacggctgcactaggamccagcagtcagaccggsccccascctggagtgaacacatcgccactgccag

SEQ ID NO: 16912 - DNA, 472 bp, Homo sapiens
catcagtgttctcctgccttcaaactcagtcttaaactgtaacttctcccttcagttctgttggttctcaggcctttggacgcagtctgaaatgatgccatcagctctcctgggtctccagcttgcctactacagatcttgaggcatgtcaacctctacaaccacatgagccaattccttatgataaatcataaacacacacacaccgcaaacacacacacacatttccatcctattggttctgtttctctgcagggtccagattaagacagcaatatagactgtgctcaaasactggyammwtttaccsatctcaagatggaaggagcccctcaargtagctctkaaaatgtttgcaatgtgccggggtagtcagctgacctttttctgcccctgtttaattgtcagaaaaacataagttggatttagtgstccttggaagaataattcatctttaagtctgtaactctga

SEQ ID NO: 16913 - DNA, 439 bp, Homo sapiens
catcagtgttctcctgccttcaaactcagtcttaaactgtaacttctcccttcagttctgttggttctcaggcctttggacgcactgaaatgatgccatcagctctcctgggtctccagcttgcctactacagatcttgaggcatgtcaacctctacaaccacatgagccaattccttatgataaatcataaacacacacacaccgcaaacacacacacacatttccatcctattggttctgtttctctgcagggtccagattaagacagcaatatagactgtgctcaaacactgstacatttaccatctcaagatggaaggagccctcaaagtagctcttwaaatgtttgcaatgtgccggggtagtcagctgacctttttctgcccctgtttaattgtcagaaaaacataagttggatttagtgctccttgaagaat

SEQ ID NO: 16914 - DNA, 449 bp, Homo sapiens
catcaacttctggacatttaaatacatgcatattagatagttttcactgtatcctatctctttactctcagtcttgcactttttaccttggtctttcaaagccgatgcctttttctgacaaattttatagttcattaatgtcactatggagctgtatctaatttgttgttaaatccatcagttgaattttcagttgtagaatttgtattaggttctttatcaaacctataatgtcattttatagttcctggttccctgatgaaatttccaagcttggctgcttctttgaccttagtgaacaattgttgtgtaatctgagttggccaattatagtatcttaaggttttttgtggtctgttgctcatgttggttctcacatatgaagtcttttcttgtgtgcctggttttctttgtgtgctaaacatgtatttgtaaaaaaaaaaaaaaaa

SEQ ID NO: 16915 - DNA, 510 bp, Homo sapiens
ctatcgcgagaacagcatgggggaaaccacctccgtgatccaatgaccggcacgtggtcccacccttgatacatggggattattagaatcaaagtaagatttgagtggagacatacagccaaaccctatcaaatatcttaaaccaatatagttcatattttattacttttaactgtactttttctttcctccttttggaacgaggggatccatgctttcattttgcacagggcccaacatattatgtatccatttcgtatctctgccttgtatgtttaattttcttaactaaaataaataggtaatagggatgtttttatttctgttcttcttaatatctagaaaacataagttgtatttacttcatctgatctcttctctcttttcctcatgctctggctccccttggttacataactgtctttacacctgctcatattttccagagagttaagaaaccattttttttagaataaaactctgagcttaagatcttagacattttttttt

SEQ ID NO: 16916 - DNA, 193 bp, Homo sapiens
aaacccgggtggggtggcggggcggcggggtgacggggcacgaggccgggattccaccgcagactccgaagaggcaggggcatccagtggttcaaggttacaataagctgtgatcgtgccactgcattctacctgggatgacagagtgggaccctgtgccacagagtagaccctgtctcaaaaaaaaaaaaaa

SEQ ID NO: 16917 - DNA, 503 bp, Homo sapiens
gccgaagaagagcgggcgacaaaggtgcgggatggcatggattctgcaactctccccagcctccactgcgtttcgaagcgacgcccttgactgaggagtgtttttaataatcatctggccgacttggaagctggaggccgaasatagctgtcaattttcttgcgttccttctgcttcctcggggcagagatggtgaaatctacttgttaggacagttgcaaacccgattgcagtctgggctctggatgctggaattatcctgtgatgattcatcatctttaacagaaagccgaggttacagagcccagagtgatttttgacgttccacaatattccacgaacattttctgattgctcactatatgcatagattgactgagtctctgggggaaagatgtagaagacaggagttctaaaccctaggaagtgcatcaccggtagtggcgccggctgtagtcccagctacttggggaggaaaccagatccttaagtcatttctctct

SEQ ID NO: 16918 - DNA, 445 bp, Homo sapiens
agagagtgggagaaaccggggagcagcgggagcagcaggtccggggggagctgttccgctgcgctgccctcgttattcacacggacgctgcggasttcccagggctgcttccctgtccccctgggtggaggctgccgtctaaacctgactccagagtttaagatgcaatggccagaagacatgaacgtgtcactagaaggatgtggacatgggctccgggactgttgatgatgactgtggtgttttggggtcatcaggggaatggacaaggccaaggatcgcgtcttcgccaggaggactttcccccgcggattgtggagcatccttccgatgtcatcgtctctaagggcgagcccacgactctgaactgcaagcggagggccggccaacgcccaccattgagtggtacaaagatggggatcgagtggagactgacaaggacgat

SEQ ID NO: 16919 - DNA, 505 bp, Homo sapiens
actccgtctcgccctgccccggcgggggtcaggatcctccacagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgct

SEQ ID NO: 16920 - DNA, 478 bp, Homo sapiens
attgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacggagctgaaggacggggggcggtaggggtcttgatgaaacctcttgaacgaagcacagtttgtcccatctttgttcactcgtgtgtctcaaccatctttaatagcatgctgctcctt

SEQ ID NO: 16921 - DNA, 491 bp, Homo sapiens
aggatcctccacagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcagggttatgaggacctgtcagcagctaagtgtctctgacaagcagttgactgacatataattgatggagaagaaacaagaagcataaaagggcaattgaaggaacagactaaaaatcgtgtcctggaagaaactacaggtactaccaggggattttcagtctgagaagaaaagacaaaaatwgatgacagaaggagtattagaagggagagcgatg

SEQ ID NO: 16922 - DNA, 526 bp, Homo sapiens
gcgggcggtgatcgaagggctgaagatgcggaggaggccgagtcgctaggcgctttcgggggcgctgtgccggtgaggcttaggcaaggggacggggaaccgtggttagatgcagcagccctcccaggtcccacttctttggcgttcctgctgcctgtsactcaagacaattgacttccasctsaassctcakctccgaacgccttgcattagaagctagagctttggaggttctgaggacggtccctggggagcaagtggaacttcttcctctttgaaaccggtttcccaagggaactgcctgtgtgactgaraggctagtaatctgtttgtagatgatttatattttggctgcagaatgaatccccctccctactcggagtactctccttagagatgatcccccgcmccctccccatgggttcgctctcagagctgggatctgtataaagagcgctgtgggagtcttttgccctccgctctagctctatcttcctccggaccccgaagcttaagaattatccgc

SEQ ID NO: 16923 - DNA, 531 bp, Homo sapiens
agatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaaataaatgtgtgattg

SEQ ID NO: 16924 - DNA, 154 bp, Homo sapiens
agagggagggttaaggcgcctgggcsacagcgagccggctgagggggctgtggcggccgcggcgggcgacatggacaacgcggggaaggagcgtgaggcagtacagctgatggcggaggccgagaagcgagtcaaggcctcccactccttcctc

SEQ ID NO: 16925 - DNA, 219 bp, Homo sapiens
aagactatactttcagggatcatttctatagtgtkttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgakagggagagaacgcggtctgagtggaag

SEQ ID NO: 16926 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtcttagtgaaaaamaaaaaaaaaaaaag

SEQ ID NO: 16927 - DNA, 224 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaa

SEQ ID NO: 16928 - DNA, 233 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaa

SEQ ID NO: 16929 - DNA, 232 bp, Homo sapiens
aagactatactttcagggatcatttctatagtgtgttactagagaggtttctctgaacgtgtagagcaccgaaaaccacgaggaagagaggtagcgttctcctgagcgtgaagccggctttctggcgttgcttggctgcaactgccgtcagccattgatgatcgttcttctctccgtattggggagtgagagggagagaacgcggtctgagtaagaaaaaaaaaaaaaaaaa

SEQ ID NO: 16930 - DNA, 233 bp, Homo sapiens
aagactatactttcagggatcatttctatagtgtgttactagagaggtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaa

SEQ ID NO: 16931 - DNA, 220 bp, Homo sapiens
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaa

SEQ ID NO: 16932 - DNA, 272 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaaaaaaaaaaaaaaaaaaaaaaaaaaaaaaaaaaaaaaaaaaaaaaaaaaaaaaa

SEQ ID NO: 16933 - DNA, 266 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtragagggagagaacgcggtctgagtaaaaaaaaaaaaaaaaaaaaaaaagaaaaaaaaaaaaaaaaggtcaaaagct

SEQ ID NO: 16934 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtttgagtaaaaaaaaaaaaaaaaa

SEQ ID NO: 16935 - DNA, 236 bp, Homo sapiens
  misc_feature 155: n=a, g, c or t
aagactatactttmagggatcaatttctatagtgttttttagagaagtttctctgaacgtgtagagcaccgaaaaccacgaggaagagaggtagcgttttctcctgagcgtgaagccggctttctggcgttgcttggctgcaactgccgtcagcnattgatgatcgttcttctctccgtattggggagtgatagggagagaacgcggtctgagtggaagaaaaaaaaaaaaaaaaa

SEQ ID NO: 16936 - DNA, 269 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctaactgccgtcagccattgatgatcgttcttctctccgtattggggagtgagagggagagaacgcggtctgagtggaaaaaaaaaaaaaaaaaaaaaaaaaaaaaaaaaaaaaaaaaaaaaaaaaaaaaaaa

SEQ ID NO: 16937 - DNA, 220 bp, Homo sapiens; identical to SEQ ID NO: 16931

SEQ ID NO: 16938 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaa

SEQ ID NO: 16939 - DNA, 230 bp, Homo sapiens
aagactatactttcagggatcatttctatagtgtgttactagagaagtttctctgaacgtgtagagcaccgaaaaccacgaggaagagaggtagcgttttctcctgagcgtgaagcmggctttctggcgttgcttggctgcaactgccgtcagccattgatgatcgttcttctctccgtattggggagtgagagggagagaacgcggtctgagtgaaaaaaaaaaaaaaa

SEQ ID NO: 16940 - DNA, 234 bp, Homo sapiens
aagamtawamyttycarggrwycawttyytaatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaa

SEQ ID NO: 16941 - DNA, 236 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaaaaaaaaaaaaaa

SEQ ID NO: 16942 - DNA, 243 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaaa

SEQ ID NO: 16943 - DNA, 236 bp, Homo sapiens; identical to SEQ ID NO: 16941

SEQ ID NO: 16944 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaa

SEQ ID NO: 16945 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagsmggctttctggcgttgsttggctgcaactgccgtcagccattgatgatcgttcttctctccgtattggggagtgagagggagagaacgcggtctgagtaaaaaaaaaaaaaaaaaa

SEQ ID NO: 16946 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaasscaaaaaaaaaaaaaaaa

SEQ ID NO: 16947 - DNA, 528 bp, Homo sapiens
atctttgggagctgcatttttgataaataagaaaaacctcctcattttaatgaagtagtttcaatggagcaaaaacatggaattaaagaaccacagttcaactccatcaatgaagtaacatcatttgccaactaacaaactgagtctacatctctttatttgcaatgtaaaaccccatcctgttaggggaaaaaaaaatagtactaatgttggatttagaagtccggagttcaattttaggctttggagagaagtaatccacttttacttgagatttccaatctcatatcaccaccatcatcattatcaccattatcatcaccaccaccaccaccatgagcaaccaacatcatcatcatcaagaacaacttgcttttgctagccaaagcaatgggaacacagcactctattagggggcaaggtattaatttgctttttatttaattataacaaaagcgaaatacatgtttttgtaatttcctatcaataatttagaagaattaaatataaatataaaataaaaaccaa

SEQ ID NO: 16948 - DNA, 425 bp, Homo sapiens
taagcgccagtctccgccttgcgagctcagagtgtgcccgctgcgccgccgctgtccgtacctgccgccgccgccaccgcsaccatgcccaacttcgccggcacctggaagatgcgcmrgcgagaatttcgacgagctgctcaaggcactsgggtgtgaacgccatgctgaggaaagtggccgtagcggctgcgtccaagccgcacgtggagatccgccagacggggatcagttctacatcaagacatccaccacggtgcgcaccactgagatcaacttcaaggtcggagaaggctttcaggaggagaccgtggacggacgcaagtgcaggagtttagccacttgggagaatgagaacaagatccactgcacgcaaactcttcttgaaggggacggccccaaaacctactggacccgtgagctgg

SEQ ID NO: 16949 - DNA, 221 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaat

SEQ ID NO: 16950 - DNA, 250 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagcgcaaaaaaaaaaaa

SEQ ID NO: 16951 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaa

SEQ ID NO: 16952 - DNA, 242 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaa

SEQ ID NO: 16953 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaataaagaaaaaaaaaa

SEQ ID NO: 16954 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagscaaaaaaaaaaaaaaaa

SEQ ID NO: 16955 - DNA, 234 bp, Homo sapiens
  misc_feature 234: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggsgttgcttggctgcaactgccgtcagccattgatgatcgttcttctctccgtattggggagtgagagggagagaacgcggtctgagtgaaaaaaaaaaaaaaaaaan

SEQ ID NO: 16956 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaa

SEQ ID NO: 16957 - DNA, 234 bp, Homo sapiens; identical to SEQ ID NO: 16951

SEQ ID NO: 16958 - DNA, 242 bp, Homo sapiens; identical to SEQ ID NO: 16952

SEQ ID NO: 16959 - DNA, 526 bp, Homo sapiens
gcgctcctagtctccactgctgccgccgtcgccgccacccgagccggagcgggctgggccgccaaggcaagatggttggactacagcgtgtggggaccacattgaggtgtctgatgatgaagacgagacgcaccccaacatcgacacggccagtctcttccgctggcggcatcaggcccgggtggaacgcatggagcagttccagaagggrgaagggaggaactggacagggggctgccgcgagtgcaagcgcaaggtggccgagtgccagaggaaactgaaggagctggaaggtggccgagggcggcaaggcagagctggagcgcctgcaggccgaggcacagcagctgcgcaaggarggagcggactgggggagccagaagctgggaggagatgcgcaagaaggagaagagcatgccctggaacgtggacacgctcagcaaagacggcttcagcaagagcatggtaaataccaagcccgagaagacggaggaggactcagaggaggtgagggagcagaaacaca

SEQ ID NO: 16960 - DNA, 238 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaaaaaaaaaaaaaaaaaaaaa

SEQ ID NO: 16961 - DNA, 231 bp, Homo sapiens; identical to SEQ ID NO: 16956

SEQ ID NO: 16962 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccrrtattggggagtgagagggagagaacgcggtctgagtgaaaaawaaaaaaaaaa

SEQ ID NO: 16963 - DNA, 226 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaaga

SEQ ID NO: 16964 - DNA, 231 bp, Homo sapiens; identical to SEQ ID NO: 16956

SEQ ID NO: 16965 - DNA, 293 bp, Homo sapiens
aagactatactttcagggatcagttctatagtgtgttactagagaagtttctctgaacgtgtagagcaccgaaaaccacgaggaagagaggtagcgttttctcctgagcgtgaagccggctttttggcgttgcttcgctgcaactgccgtcagccattgatgatcgttcttctctccgtattggggagtgagagggagagaacgcggtaaaaaaaaaaagaaaaaagaaaaaaaaaaaaaaaaaaaaaaaaaaaaaaaaaaaaaaaaaaaaaaaaaaaaaaaaaaaaaaaaaa

SEQ ID NO: 16966 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaar

SEQ ID NO: 16967 - DNA, 231 bp, Homo sapiens; identical to SEQ ID NO: 16956

SEQ ID NO: 16968 - DNA, 225 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaa

SEQ ID NO: 16969 - DNA, 224 bp, Homo sapiens
aagactatactttcagggatcatttctatagtgtgttactagagaagtttctctgaacgtgtagagcaccgaaaaccacgaggaagagaggtagcgttttctcctgagcgtaasbggctttctggcgttgcttggctgcaactgccgtcagccattgatgatcgttcttctctccgtattggggagtgagagggagagaacgcggtctgagaaaaaaaaaaaaa

SEQ ID NO: 16970 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagscggctttctggcgttgcttggctgcaactgccgtcagccattgatgatcgttcttctctccgtattggggagtgagagggagagaacgcggtctgagtaaaaaaaaaaaaaaaaa

SEQ ID NO: 16971 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaag

SEQ ID NO: 16972 - DNA, 243 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaaa

SEQ ID NO: 16973 - DNA, 241 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaataaagaaaaaaaaaaaaaaaaa

SEQ ID NO: 16974 - DNA, 244 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagcgcaaaaaa

SEQ ID NO: 16975 - DNA, 243 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaag

SEQ ID NO: 16976 - DNA, 231 bp, Homo sapiens
aagactatactttcagggatcatttctagagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaa

SEQ ID NO: 16977 - DNA, 230 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaa

SEQ ID NO: 16978 - DNA, 253 bp, Homo sapiens; identical to SEQ ID NO: 16946

SEQ ID NO: 16979 - DNA, 231 bp, Homo sapiens; identical to SEQ ID NO: 16956

SEQ ID NO: 16980 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctstccgtattggggagtgagagggagagaacgcggtctgagtgaaaaaaaaaaaaaaaaaaa

SEQ ID NO: 16981 - DNA, 242 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaasscaaaaa

SEQ ID NO: 16982 - DNA, 236 bp, Homo sapiens
aagactatactttcagggattatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaaaaaaaaaaaaaa

SEQ ID NO: 16983 - DNA, 277 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctacaactgccgtcagccattgatgatcgttcttctctccagtattggggagtgagatggagagaacgcggtctgaaaataaaaaaaagaaaataaaaaaaaaaaaaaaaaaaaaaaaaaaaaaaaaaaaaaaaaaaaaa

SEQ ID NO: 16984 - DNA, 231 bp, Homo sapiens; identical to SEQ ID NO: 16956

SEQ ID NO: 16985 - DNA, 232 bp, Homo sapiens
  misc_feature 155: n=a, g, c or t
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagcnattgatgatcgttcttctctccgtattggggagtgagagggagagaacgcggtctgagtgaaaaaaaaaaaaaaaaa

SEQ ID NO: 16986 - DNA, 242 bp, Homo sapiens; identical to SEQ ID NO: 16952

SEQ ID NO: 16987 - DNA, 253 bp, Homo sapiens; identical to SEQ ID NO: 16954

SEQ ID NO: 16988 - DNA, 256 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctaactgccgtcagccattgatgatcgttcttctctccgtattggggagtgagagggagagaacgcggtctgagtggaaaaaaaaaaaaaaaaaaaaaaaaaaaaaaaaaaaaaaaaaaa

SEQ ID NO: 16989 - DNA, 283 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaaaaaaaaaaaaaaaaaaaaaaaaaaaaaaaaaaaaaaaaaaaaaaaaaam

SEQ ID NO: 16990 - DNA, 241 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaa

SEQ ID NO: 16991 - DNA, 254 bp, Homo sapiens
  misc_feature 254: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaamaaaaaaaagscaaaaaaaaaaaaaaaan

SEQ ID NO: 16992 - DNA, 225 bp, Homo sapiens
  misc_feature 221: n=a, g, c or t
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaatnaaag

SEQ ID NO: 16993 - DNA, 242 bp, Homo sapiens; identical to SEQ ID NO: 16952

SEQ ID NO: 16994 - DNA, 231 bp, Homo sapiens; identical to SEQ ID NO: 16956

SEQ ID NO: 16995 - DNA, 231 bp, Homo sapiens; identical to SEQ ID NO: 16956

SEQ ID NO: 16996 - DNA, 237 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaagaaaaaaaaaaaaaaaaag

SEQ ID NO: 16997 - DNA, 242 bp, Homo sapiens; identical to SEQ ID NO: 16952

SEQ ID NO: 16998 - DNA, 237 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggakagaacgcggtctgagtggaagaaaaaaaaaaaaaaaaaa

SEQ ID NO: 16999 - DNA, 224 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaawbaa

SEQ ID NO: 17000 - DNA, 372 bp, Homo sapiens
ccttcaaatctagattccaaattacagaaatgcagtcattgtagctaagtctcctgatgctgcaaagaggtaagtaagctagacatgggtcctgatccctcctgagtgctcccgaagtcagaatgagctgctttggaatccagaggctgtcactcgtggcctttgaaagcccactggctctcatgttaacccctccatcgttgtcatgtcccatgccacacacagctttatctccagcctccagacagcacacatgatcgctgagttgctcagctttcctctgggaaaacaaagttccttcaagttctcagagaaaggaaagcaatgaggctatgagcatttttcaagcaatggtttttttttttgtttttt

SEQ ID NO: 17001 - DNA, 233 bp, Homo sapiens
  misc_feature 221: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaanaaaaaaaaaaaa

SEQ ID NO: 17002 - DNA, 220 bp, Homo sapiens; identical to SEQ ID NO: 16944

SEQ ID NO: 17003 - DNA, 235 bp, Homo sapiens
aagactatactttcagggatcatttctatagtgttttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgatagggagagaacgcggtctgagtggaagaaaaaaaaaaaaaaaaa

SEQ ID NO: 17004 - DNA, 232 bp, Homo sapiens; identical to SEQ ID NO: 16929

SEQ ID NO: 17005 - DNA, 241 bp, Homo sapiens; identical to SEQ ID NO: 16990

SEQ ID NO: 17006 - DNA, 231 bp, Homo sapiens; identical to SEQ ID NO: 16956

SEQ ID NO: 17007 - DNA, 234 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaargc

SEQ ID NO: 17008 - DNA, 243 bp, Homo sapiens; identical to SEQ ID NO: 16972

SEQ ID NO: 17009 - DNA, 235 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaa

SEQ ID NO: 17010 - DNA, 241 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagaaaaaaaaaaaaaggaaaaaaaaaaaaa

SEQ ID NO: 17011 - DNA, 474 bp, Homo sapiens
aaagtgctggattccaagggactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaa

SEQ ID NO: 17012 - DNA, 232 bp, Homo sapiens; identical to SEQ ID NO: 16929

SEQ ID NO: 17013 - DNA, 228 bp, Homo sapiens
aagactatactttcagggatcatttctatagtgtgttgctagagaagtttctctgaacgtgtagagcaccgaawacbacgaggwagagaggtagcgttttctcctgagcgtgaagctggctttctggcgttgcttagctgcaactgccgtcagcbattgatgatcgttcttctctccgtattggggagtgagagggagagaacgcggtctgagtggtgaacaaaagad

SEQ ID NO: 17014 - DNA, 236 bp, Homo sapiens; identical to SEQ ID NO: 16941

SEQ ID NO: 17015 - DNA, 242 bp, Homo sapiens; identical to SEQ ID NO: 16952

SEQ ID NO: 17016 - DNA, 240 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaarscaaa

SEQ ID NO: 17017 - DNA, 233 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaaag

SEQ ID NO: 17018 - DNA, 231 bp, Homo sapiens
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaa

SEQ ID NO: 17019 - DNA, 254 bp, Homo sapiens
  misc_feature 235: n=a, g, c or t
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaancscaaaaaaaaaaaaaaaa

SEQ ID NO: 17020 - DNA, 232 bp, Homo sapiens
aagactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaa

SEQ ID NO: 17021 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaag

SEQ ID NO: 17022 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaarscaaaaaaaaaaaaaaaa

SEQ ID NO: 17023 - DNA, 237 bp, Homo sapiens
aagactatactttcagggatcatttctatagtgttttactagagaagtttctctgaacgtgtagagcaccgaaaaccacgaggaagagaggtagcgtttttctcctgagcgtgaagccggctttctggcgttgcttggctgcaattgccgtcagccattgatgatcgttcttctctccgtattggggagtgatagggagagaacgcggtctgagtggaagaaaaaaaaaaaaaaaaa

SEQ ID NO: 17024 - DNA, 231 bp, Homo sapiens; identical to SEQ ID NO: 16956

SEQ ID NO: 17025 - DNA, 232 bp, Homo sapiens; identical to SEQ ID NO: 17020

SEQ ID NO: 17026 - DNA, 220 bp, Homo sapiens; identical to SEQ ID NO: 16944

SEQ ID NO: 17027 - DNA, 230 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtaaaaaaaaaaaaaaaaa

SEQ ID NO: 17028 - DNA, 231 bp, Homo sapiens; identical to SEQ ID NO: 16956

SEQ ID NO: 17029 - DNA, 231 bp, Homo sapiens
aagactatactttcagggatcatttctatagtgtgttactagagaagtttctctgaacgtgtagagcaccgaaaaccatgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaa

SEQ ID NO: 17030 - DNA, 242 bp, Homo sapiens; identical to SEQ ID NO: 16952

SEQ ID NO: 17031 - DNA, 231 bp, Homo sapiens; identical to SEQ ID NO: 16956

SEQ ID NO: 17032 - DNA, 491 bp, Homo sapiens
attcttcttttggaacccagatgtctagaccagcagaaactgaagtgcatactcagagcctcgtttttcagcatgacctccagtgagcacacataagtaaacagaagcttaaatttgcttaaaaaataagagcaaaaatgttttgaattaaatcttattcagccaacgtggttagagatggaaatgtgacaagctctcaagtgaacatgaagaagcatcttggaaatactattatccctaacccatctcattgagttcacagtgtgtaactgcatctgaacatgtttagttgctttacaggtgacagcaactcaacattgattagagactggaagaaagaagaaaaatcatatcctctcaaatttaacacaatttacaaagaaatagtgttcacttaaaatattagaaaggggaaaagtatgtttgctttgtttttaccaggagcttataaatgtgctttgtatcagaagtgcatgctctatgtctgcaca

SEQ ID NO: 17033 - DNA, 254 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaarssaaaaaaaaaaaaaaaaa

SEQ ID NO: 17034 - DNA, 236 bp, Homo sapiens; identical to SEQ ID NO: 16941

SEQ ID NO: 17035 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaagccggcttkctggcgttgcttggctgcaactgccgtcagccattgatgatcgttcttctctccgtattggggagtgagagggagagaacgcggtctgagtaaaaaaaaaaaaaaaaa

SEQ ID NO: 17036 - DNA, 230 bp, Homo sapiens; identical to SEQ ID NO: 17027

SEQ ID NO: 17037 - DNA, 225 bp, Homo sapiens; identical to SEQ ID NO: 16968

SEQ ID NO: 17038 - DNA, 223 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaa

SEQ ID NO: 17039 - DNA, 247 bp, Homo sapiens
aaagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaagaaaaaaaaaaaaaaaaaaaaaaaaaaaa

SEQ ID NO: 17040 - DNA, 237 bp, Homo sapiens
agactatactttcagggatcatttctatagtgtgttactagagaagtttctctgaacgtgtagaacaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaaaaaaaaaaaaaaaaaaaa

SEQ ID NO: 17041 - DNA, 231 bp, Homo sapiens; identical to SEQ ID NO: 16956

SEQ ID NO: 17042 - DNA, 242 bp, Homo sapiens; identical to SEQ ID NO: 16952

SEQ ID NO: 17043 - DNA, 487 bp, Homo sapiens
ctgacttctgagtttatagaagtttcagttctgaagtttaagaggagtttcacttcatcccttttcattttgaaggcagctgaaaaagttggatgaagatagtttaaccaaacaaccagaagaagtatttgatgtcttagagaaacttggagaagggtgagtgtaaagaaactataggtaggtcattgggtcccagtctttttcctgccccagaagaagcagaaggatatgaacctttcagcattgttctaggtggggtggaaggtaaatttacagcttgtgatgtccttcttcgctttactccaatccctattatagacagatttagtgattcctggtctttttaacacgaagaatatctattgttttctcttttgtagsatctgtatgattttatctacttaacagatagcactaattagattaarattctataagaaactttttaatttgctgttcataatttctgattggtatgcataactgt

SEQ ID NO: 17044 - DNA, 220 bp, Homo sapiens
aagactatactttcagggatcatttctatagtgttttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgatagggagagaacgcggtctgagtggaaga

SEQ ID NO: 17045 - DNA, 230 bp, Homo sapiens; identical to SEQ ID NO: 16977

SEQ ID NO: 17046 - DNA, 242 bp, Homo sapiens; identical to SEQ ID NO: 16952

SEQ ID NO: 17047 - DNA, 241 bp, Homo sapiens; identical to SEQ ID NO: 16973

SEQ ID NO: 17048 - DNA, 253 bp, Homo sapiens
aagactatactttcagggatcatttctatatatgttactagagaagtttctctgaacgtgtagagcaccgaaaaccacgaggaagagaggtagcgttttctcctgagcttgaagccggctttctggcgttgcttggctgcaactgccgtcagccattgatgatcgttcttctctccgtattggggagtgagagggagagaacgcggtctgagtgaaaaaaaaaaaaaaaaaaasscaaaaaaaaaaaaaaaaa

SEQ ID NO: 17049 - DNA, 270 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaaaaaaaaaaaaaaaaaaaaaammaaaaaaaaaaaaaa

SEQ ID NO: 17050 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaga

SEQ ID NO: 17051 - DNA, 228 bp, Homo sapiens
aagactatactttcagggatcatttctatagtgtgttactagagaagtttctctgaacgtgtagagcaccgaaaaccacgaggaagagaggtagcgttttctcctgagcgtgaascggctttctggcgttgcttggctgcaactgccgtcagccattgatgatcgttcttctctccgtattggggagtgagagggagagaacgcggtctgagtggaaaataaagaaaa

SEQ ID NO: 17052 - DNA, 231 bp, Homo sapiens
aagactatactttcagggatcatttctatagtgtgttactagagaagtttctctgaacgtgtagagcaccgaaaaccacgaggaagagaggtagcgttttctcctgagcgtgaaccggctttctggcgttgcttggctgcaactgccgtcagccattgatgatcgttcttctctccgtattggggagtgagagggagagaacgcggtctgagtaaaaaaaaaaaaaaaaaa

SEQ ID NO: 17053 - DNA, 245 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaagaaaaaaaaaaaaaaaaagsc

SEQ ID NO: 17054 - DNA, 500 bp, Homo sapiens
atctttgggagctgcatttttgataaataaggtgagcaaagaggttacataactcacccaaagccagagttagtaaatggaagaactggaatttgcaccccggcaatcttgctccatgtggtggattgctatagtaaacggttcatcacaatgaaaaccttagagatgtaatgtctcatgtcacacagtgagtctgtaaggcgtttaggaatagaatctggctcaactggctggatcacacgtatgacttcttcactgccaaacccagagtaatggaagccccatggctggatactttgttgtttatattccacgtgtttattatactgtaggagcatgagtggattcaatgcttttaaaaagcacccagtgaaataaaaaatcccactgtagtttggcaaaaatggaagtaatgacaaagaatgtctgaacacattttaattagagctactggtctgttcttgacctctctcttctgttaaatccaggacaatgtcttt

SEQ ID NO: 17055 - DNA, 232 bp, Homo sapiens; identical to SEQ ID NO: 17020

SEQ ID NO: 17056 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaaagcaaaaaaaaaaaaaaaa

SEQ ID NO: 17057 - DNA, 231 bp, Homo sapiens
aaagactatactttcagggatcatttmwatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagcaaaaaaaaaaaaaaaa

SEQ ID NO: 17058 - DNA, 225 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaataaag

SEQ ID NO: 17059 - DNA, 224 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaa

SEQ ID NO: 17060 - DNA, 232 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtaaaaaaaaaaaaaaaaaa

SEQ ID NO: 17061 - DNA, 220 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaaaa

SEQ ID NO: 17062 - DNA, 232 bp, Homo sapiens
aagastatactttcagggatcatttctatagtgtgttactagagaagtttctctgaacgygtagagcaccgaaaaccacgaggaagagaggtagcgttttctcctgagcgtgaaccggstttctggcgttgcttggctgcaactgccgtcagccattgatgatcgktgcttctctccgtattggggagtgagagggagagaacgcggtctgagtggaaaataaagaaaaaak

SEQ ID NO: 17063 - DNA, 253 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgaaaaaaaaaaaaaaaaaaagccaaaaaaaaaaaaaaaa

SEQ ID NO: 17064 - DNA, 256 bp, Homo sapiens
  misc_feature 77,156: n=a, g, c or t
aagactatastttcagggatcattttctatagtgtgttactagagaagtttctctgaacgtgtagagcaccgaaaancasgaggaagagaggtagcgttttytcctgagcgtgaagccggctttctggcgttgcttggctgcaactgccgtcagcnattgatgatsgttcttctctccgtattggggagtgagagggakgagaacgcggtctgagtgaaaaaaaaaaaaaaaaaaascgcaaaaaaaaaaaaaaaa

SEQ ID NO: 17065 - DNA, 219 bp, Homo sapiens
atacttagcaccatttcactaaggaaccttgaatacaaccaggatcctcctttgcatgcgactgtagctgcatttcatgaatagtttgaacccttgtcaatgcattttttgaaaaagaaagaaaaaaaaaaacttcgtgtatgtgactcaaagcatgtaaccttaagatgttgcattctaaactgacaataaagacctttcccaaaaaaaaaaaaaaaa

SEQ ID NO: 17066 - DNA, 242 bp, Homo sapiens; identical to SEQ ID NO: 16952

SEQ ID NO: 17067 - DNA, 261 bp, Homo sapiens
aaagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggaagaaaaaaaaaaaaaaaaaaaaaaaaaaaaaaaaaaaaaaaaa

SEQ ID NO: 17068 - DNA, 226 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagaaaaaaaaaaaaa

SEQ ID NO: 17069 - DNA, 236 bp, Homo sapiens; identical to SEQ ID NO: 16941

SEQ ID NO: 17070 - DNA, 236 bp, Homo sapiens; identical to SEQ ID NO: 16941

SEQ ID NO: 17071 - DNA, 241 bp, Homo sapiens
aagactatactttcggggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttmtctccgtattggggagtgagagggagagaacgcggtctgagtggtaaaaaaaaaaaaaaaaaaaaaaaa

SEQ ID NO: 17072 - DNA, 235 bp, Homo sapiens; identical to SEQ ID NO: 17003

SEQ ID NO: 17073 - DNA, 242 bp, Homo sapiens; identical to SEQ ID NO: 16952

SEQ ID NO: 17074 - DNA, 253 bp, Homo sapiens; identical to SEQ ID NO: 16946

SEQ ID NO: 17075 - DNA, 231 bp, Homo sapiens; identical to SEQ ID NO: 16956

SEQ ID NO: 17076 - DNA, 487 bp, Homo sapiens
tattaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggctcctagaactttttgttttatgtactttaa

SEQ ID NO: 17077 - DNA, 253 bp, Homo sapiens; identical to SEQ ID NO: 16946

SEQ ID NO: 17078 - DNA, 235 bp, Homo sapiens
aagactatactttcagggatcatttctatagtgttttactagagaagtttctctgaacgtgtagagcaccgaaaaccacgaggaagagaggtagcgttttctcctgagcgtgaascggctttctggcgttgcttggctgtaactgccgtcagccattgatgatcgttcttctctccgtattggggagtgatagggagagaacgcggtctgagtggaagaaaaaaaaaaaaaaaaa

SEQ ID NO: 17079 - DNA, 231 bp, Homo sapiens; identical to SEQ ID NO: 16956

SEQ ID NO: 17080 - DNA, 233 bp, Homo sapiens; identical to SEQ ID NO: 16928

SEQ ID NO: 17081 - DNA, 236 bp, Homo sapiens; identical to SEQ ID NO: 16941

SEQ ID NO: 17082 - DNA, 231 bp, Homo sapiens; identical to SEQ ID NO: 16956

SEQ ID NO: 17083 - DNA, 231 bp, Homo sapiens; identical to SEQ ID NO: 16956

SEQ ID NO: 17084 - DNA, 418 bp, Homo sapiens
atttacacgccttgtggggctggcaaatgttccaaatctgccactatgaaataattggcagcaaggatgggaaaaagaaaaacctcattttaatggtccttacctctggtttggctttcacagtgaagccaaaccaggacagcttgttacacagagtctggaaagcagcccttcatgttgggattctggaattgggtcactgccgagtcagatttcaataaggaaaacatacttgaaaatcatgctgaccaactatattgatgacattaggctaatttgacatggtagacaagaaattccaagtactgttctdtgcattattggtaactgtgtctgctgtgctttggaataaggtccaagatttgaaaatgactttggaactctctcaagaaatcccttatccaagaaatacggataa

SEQ ID NO: 17085 - DNA, 249 bp, Homo sapiens
taaaaggaaaaaaaatgttttgaaacagataatagacttacataaagtgttgctgggatgttgtgggctctaaagctgttgtttgcagcaggtaccagactggtgcatctggatgacctccccccatagtacctgcagcattttggggtgtttgggtgaaggtggattgttgacagcacataaccagcatttagattttaaggatctgcctttagatatgggttcatggccaaaaaaaaaaaaaaaaag

SEQ ID NO: 17086 - DNA, 513 bp, Homo sapiens
  misc_feature 297: n=a, g, c or t
gactgctgccttatgctcttgggtgaacgaggcttggtgtagatggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctccttgggcccatgaggactctattcactttttgctggttttggcctacagtttgaatctttgccaggctgtttcctgtngttggcagtttaatgaacggtagtaacattgattccacatctaggtttactgctgagaaatatggcaaatgtaacttagagcactgataacctcactctcgtcattggtgtctagctgctcactcccaaagcctgacaagttgatgccactgctgtctgagggctcctccggctcaacagtcagctcagtgcttgtgtaattcttccgggctttta

SEQ ID NO: 17087 - DNA, 223 bp, Homo sapiens
  misc_feature 42: n=a, g, c or t
acttaagacagaggggcggcggcgggcagcagctgcgccganctgctctggaaggagaggacggggcacaaaccctgaccatgaccccccacaggctgctgccaccgctgctgctgctgctagctctgctgctcgctgccagcccaggaggcgccttgrcgggttgcccaggcwgcgggcaaggggtgcaggcgggttgtccagggggctgcgtggaggagga

SEQ ID NO: 17088 - DNA, 308 bp, Homo sapiens
agagacagatgcgaggcggcggtcagaggccctgcctgarctgccccctggggagccggaattccgctgccctgaacgcgtgatggatctcggcctgtctgaggaccacttctcccgccctgtggtctgttcctggcctctgacgtccagcagctgcggsaggcgatcgaggartgcaagcaggtgattctggagctgcccgagcagtcggagaagcagaaggatgccgtggtgcgactcatcsacctccggctgaagctccaggagctgaaggaccccaatgaggatgagccaaacatccgagtgct

SEQ ID NO: 17089 - DNA, 487 bp, Homo sapiens
aaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagkttcttactgacagaggcttaggggtgacctctctggacccagaggaagtacaacctctgtagcgagaattgtccttgggaacagaacaggcattcctcc

SEQ ID NO: 17090 - DNA, 506 bp, Homo sapiens
  misc_feature 205,208: n=a, g, c or t
atcagtcttctaatatcagtctctaagggtatagtcatatatgcaaaaataatagcccttaggaaatatatttaggcctaaatctctaagctaaggatggatttgatagtaaaaatacattaaaattataaatagctccaaggcccacacactgcccatgactttataaaatgttcttgcattcaggttatacagccagagtctnaancagaaagccagagtgttcctctagtgtgtggatttgattttgtgtctttgtgcttcctgttgcctcctggtgaacgcagtytgacctttcctttgtttgcaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactktgttataaatgctacagctgtgagagcttgtttctgatttcattgttcgc

SEQ ID NO: 17091 - DNA, 214 bp, Homo sapiens
aagtcaggaggccccgcttcggctaacgcttgcgatggttgaattcccctcctcacgccagcctaggagaagaagttcgtagtcccagaggtgaggcaggaggcggcagtttctggcgggtgagggcggastgaagtgacagcggaggcgaarcaacggtcggtggggcggagaagggggctggccccaggaggaggaggaaacccttccgaga

SEQ ID NO: 17092 - DNA, 291 bp, Homo sapiens
ggggacagcggcggcggggacggggggcggcggcggcagagtagccctaaccgctccaggtgctgccgacgctccgggtgcgggggccaccgcgggcatccactggtggtcagcaggttccaggctggtgtttacaatctcggaggaagtgcgatggtttctgttcttttgacagttcagtctgatttcaagtcagtcgaaagcgaaccagaagcaccgggcacagcagctcctctggctgtgtagacagacctkggcaatgtggccgtgcagcccagacgatcagagaga

SEQ ID NO: 17093 - DNA, 508 bp, Homo sapiens
attaactctctctcttctcctaaagaatatatacacagtgggtaagaattgcaaaataattgggtgtttcaaagacagggatgatgcacttttataaaaaaattttaatacacaagtcctctctaagcatggatatatatataaaaacagtgccagactaggagtatggagacctgggttctgggttcacctctgatgcaggctgtgtgacattaagcaaatcctaacctcttgggactgtcttttcatctgcaaaatgaagaggtagaatttagtaagtttgcgtcccatcaatgcttaaaattctataattcagaaaggcaggccattctacctagtttcatcccgctttagctcagccttactcagatatgctggccagatgtttctaatcttacacataaaagactctggtattcagaggccaaaagaaactggacaatttaagaaaagtactaagcagatgagttttccttctgtctgattcttaacagctacatgacaatta

SEQ ID NO: 17094 - DNA, 414 bp, Homo sapiens
  misc_feature 267: n=a, g, c or t
agctgcgttggctgtagaagagaacggacggcgatggcgacggtcgcagcaaatccagctgctgctgcggcggctgtggsggcggcacggcggtgactgaggatagagagccacagcacgaggagctgccaggcctggacagccagtggcgccagatagaaaacggcgagagtgggcgagaacgtccactgcgggccggcgaaactggttccttgtggagaagcactggtataagcagtgggaggcatacgtgcagggaggggacmnggactccagcaccttccctggctgcatcaacaatgccacactctttcaagatgagataaactggcgcctcaaggagggactggtggaaggcgaggattatgtgctgctcccagcastgcttggcattacctggtcagctggtatggt

SEQ ID NO: 17095 - DNA, 235 bp, Homo sapiens
attttaggtggtccgcggcggcgccattaaagcgaggaggaggcgagasggccgccgctggtgcttattcttttttagtgcagcggagagagcgggagtgtgcgccgcgcgagagtgggaggcgaagggggcaggccagggagaggcgcaggagcctttgcagccacgcgcgcgccttacccctccctttccagagaaataaactcttcccgtcgctctgccaaaaaaaaaaaaa

SEQ ID NO: 17096 - DNA, 261 bp, Homo sapiens
  misc_feature 85: n=a, g, c or t
attttaggtggtccgcggcgggccattaaagcgaggaggaggcgagasggccgccgctggtgcttattcttttttagtgcagcgngagagagcgggagtgtgcgccgcgcgagagtgggaggcgaagggggcaggccagggagaggcgcaggagcctttgcagccacgcgcgcgccttacccctccctttccagagaaataaactcttcccgtcgctctgccaaaaaaaaaaaaaaaaaaaaaaaaaaaaamaaaaaaaaa

SEQ ID NO: 17097 - DNA, 83 bp, Homo sapiens
attttaggtggtccgcggcggsccattaaagcgaggaggaggcgagasggccgccgctggtgcttattcttttttagtgcagc

SEQ ID NO: 17098 - DNA, 72 bp, Homo sapiens
agcaacggagagacgcacgctctgcacagtctattttcggagcctagccagagacgggaaaactgaccaagc

SEQ ID NO: 17099 - DNA, 449 bp, Homo sapiens
aatttggagcctgcgcagtcagatccgaggacatgttgacgtcgtccgagagtcttaaaatcctgctgtggccggattccagactcgtgggggaaaggctgatggagtttcgctcttgttgcccaagctggagtgcaatggtgccatctcggcttactgcaacctccgccccctggcttcaagcagttctcctgcctcagcctcctgagtagctgggattgcaggtgcctgccaccacgtccagcaaatttttgtatttttggtagagatggggtttcaccatgttggccaggctggagaaacgccatctctactaaaaatacaaaattagctgggcatggtggcacatgcctgtaatcccagctacttgggaaggctgaggcaggagaatcacttgaacctgggaggtcgaggttgtggtgagccgagatcgcaccattgtactccag

SEQ ID NO: 17100 - DNA, 710 bp, Homo sapiens
acttccggagaaaacagttcccctccggccggacagtggtagcggcccgacccgttctagagacggagcgggtgaaacatttttcagaagggggttattccactggaacctcgagggtggatcggagtcacgtggcgcagacgctgaaggtggatccggctacgagagtgcgcaggcgsagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacastggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagccggttggctgccatgttgttaacgagcac

SEQ ID NO: 17101 - DNA, 482 bp, Homo sapiens
catttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttcaaccctgtgtgctcagtgtttctttagttatgccaaggcttgctagaatgttatttagtgagaatttttagcttgagttgccacccaactgtgaaatcaactaaatgattacttgaatgtatttaaatgttttaaaaagcaaacattataaatttttctttaatgtcatttagtaagtgcagtcagggaatatctgaatctaagagctggccagacacagggtatagcagaattacaagcatagaggatgctatgcagtgggatgtaaagctcattacagcccatttttaagaa

SEQ ID NO: 17102 - DNA, 534 bp, Homo sapiens
ggcttttatatgcagttctggagttgggcaacacctcattctataaagtgagtgttcttatgagctgagcagagaagtttggttttatagacagaaaagggctgaggaaagcagaaacagaaaacaaaaaaagcagattgattgtttcagagcgacttttccttgtaaaggttagcagagggacttccttcacatgctggctaaaatgggcttgcttagggtttggctgccagctctccgtctcctgacttctcagaaggtcatataaaccaattagttttggctcggtcgtgtggaacttttagcatgagggactccattttggtttggtttattgggccgcgtgcaggagctcagtccaaaccagtggccctcatcaatttcacttaatatttatgcaaagcagttcagcaaggtaaaaggaggggagtcaacagggaaggctggatggcctagacccttgaagcctgcaggaggacattaatttggggggaatttgtttcatccttgaggcagtgctaaaatatatcatga

SEQ ID NO: 17103 - DNA, 434 bp, Homo sapiens
  misc_feature 171..172,174,183..186: n=a, g, c or t
gccggccaggaaccacccgttaagggatggtgaggttggaaaaaggctcctgtaaccctcctccaggatgaaccacctgccagaagacatggagaacgctctcamccgggraagccagagctcccatgcttctctgcgcaatatccattccatcaaccccacacaactmanngnbargattsnnnncctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgc

SEQ ID NO: 17104 - DNA, 442 bp, Homo sapiens
  misc_feature 30: n=a, g, c or t
atccgcagttcccgggccagcctggggcgncggccaggaaccacccgttaaggtgtcttctctttagggatggtgaggttggaaaaaggctcctgtaaccctcctccaggatgaaccacctgccagaagacatggagaacgctctcaccgggagccagagctccattgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattmmttcatattttgatatatttcttctggcagtttttcgatttaaaagtg

SEQ ID NO: 17105 - DNA, 542 bp, Homo sapiens
aaacagaattaaagaagaaagcagtaacagaaagatatctagataatccccatatattagaaattaaatgcatttttaaatagcccatagtcaaaaagtcgtcagggaaattagaaaacatcttgaatagaatggaaacaaacagacaacatgtcaaaagatatgatccagccaaagcgctattgaggaaattaaagcagttagtgatttaaaaatctcagatctcccatataaacttccacattaagaaaatagaaaaagaagagcaaattataatgaaagtaatcagaaggaaggaawtwgacaaaagcmcaactatgaagaagcagaaaattwaaatagaaaacattaaaagaaagctggttctttgagaagatcaataaatttaatgaactttagccagactaatcaggaaaagagaagacacattacaaattgcagaattgaggaagaagggacatcactactgatcctacagatgctaaaaaatagrtwatagaatattaacgattttatgccagtaaacttttaagtttaatgga

SEQ ID NO: 17106 - DNA, 92 bp, Homo sapiens
aaaaacgcgacggcggaggcgctttgctctcaccggggtcgagccgcggcgagggaacggatcggagacgctgcgcctgctcagaaggtagc

SEQ ID NO: 17107 - DNA, 477 bp, Homo sapiens
  misc_feature 362: n=a, g, c or t
aaattgctgtttagaaagatcaggacaaggttatgatttctcacccaagttcctggggaaaaggatcatgagggaattacttattaacaaggaaaaagcaaagaggaactttacaaactattacagttttccatcatcacttgactgctgacaagaagcctctttgaattccagtatacacgatcacattttaaaaccttcaagacgccgtttaatcaggagttgtaggcacatttgttagagagagctgcactttaaaaattatacagacatcacctgaagttattaaagttatcaaaacatattaaaaaccttcaagtaagaggctactccccaggaaacgtgtggagccagtgaacggnagaaaaacaattgaagggaaggcttgaaaagtccattacaaaactacagtcctttgaaaaagatttcaaagatattaaaatgaaaactgattacattaaacaataacttaaactt

SEQ ID NO: 17108 - DNA, 411 bp, Homo sapiens
agcgggtctccaggacctggcattaggacgtgcgtgttagggggcaggtatttggagccaggccccactttcgagttgtctttccgcagaccagagactgcggacggggccaggaaccaggaaccgttaggragataaggaaggtgttatagcccacattcatcctatacggccacaaggccgkgggccaggctgcctcctcacagcatcagctttttcttcggcttcatttccctctggaaagcgctttctcacagacgctgcaaagaccgaagggcagcccctgccctgctaccctccagggagccaccgctctagagcccaggctcctctggacatcatgtgacttgggggacgacttgcctttcttctgaaacacggctacagactataactttaaaacacggggct

SEQ ID NO: 17109 - DNA, 332 bp, Homo sapiens
agatccgaggacatgttgacgtcgtccgagagtcttaaaatcctgctctggccggattccagactcgtgggggaaaggctggatttcaacagatcacatggatcaaggccttagggaggtggttggggattcacgtatgccctggaccatctggagcccaagttgctgcagatcctgtcaccacgagtggacaccctctggccaccatagcaaagaagtctgaggcaggagaatcacttgaacccaggaggcagaggttgcagtgagccgagatcgcaccacagcactccagcctgggctatagagcaagactccttctcaaaaaaaaaaaa

SEQ ID NO: 17110 - DNA, 139 bp, Homo sapiens
gaggacgcccgcgagtcgggacggtggtggcagcctgtagcggtgggtctcgtccttccagggcctgcgggctctggaacgggaagtctccccagcggcagcacttgctgtggactggctgcccatgggcgatttgtgg

SEQ ID NO: 17111 - DNA, 402 bp, Homo sapiens
tttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgamcactcagctctccccaacaggtgcaaaatgcaaatgcaagtttggccagaagtccggtcaccatccaggggagactccacctctcatcamcccaggctcagcccaaagctgatgaggr

SEQ ID NO: 17112 - DNA, 449 bp, Homo sapiens
atttttattagagacggggtttcaccatgttgcctaggctggtcttgaactcctgacctcaggcgattcacccgcctcggcctcccaaagtgttaggattacaggcgtgakcaccgcgcccggcttgawttgtacacttcaaaaggtggaattttatggtgttgaattatatctttatttttttaacggggggaaaattgacgccgctggagaggagttagcggaactgaaacaatgaaatggtgcgcgagtgtcgcctgtccccgtcgcatccatcccaacgaaktttgggccctggaacggtgcacccagaaggcctgcggggagagacgctgaggcatgatctggaagaaagacgtctcaggattcgaagggaatgcagctaaggtggcggcggaggttcgcctaggactgggggaggcgtccctaggwmtcagaagttggcccgg

SEQ ID NO: 17113 - DNA, 510 bp, Homo sapiens
acattaaaggcatttttgtccttctgtactgtaggagaaaatcacgacatttcaccaggctactcaggaatactgtggtttcattttatggtgctcaggtgttttaaaattatacatcaaaaccaagtgttcagmawtgccaaaagggatgaaatgaagcttttttctttctatagttgaaaaattccttcaagcaagtgctgacatgtttccatcgaaactgtacattttttcagtggaatggcaaaagcaaagctgcttcctaatccgttttgctctttaaaataattttcaaaaattatcacatatctaggtaatacctaatttttttcttcatagttttaaatagttgtaaaggatgtaatttctgacattctgatgacatttttaaattaaaccattgcatcctttataaaaaatatatccaatagaatctaagtgtaatagaaacataatacccatttctccatctaaaaagtttctgaacaagtcagacattctttctccttt

SEQ ID NO: 17114 - DNA, 427 bp, Homo sapiens
  misc_feature 421: n=a, g, c or t
agagtgcctagaggccaggaaagggagaaggtcctaccagcctggggtagggactcgggggccaggcactgctgacgcaggctagcagggcgccactggctggtccccacccacctcggtgtttgggggatgggcgcaccagccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcactggaagctagtggacagcaagaatttcgatgactacatgaagtcactcggtgtgggttttgctaccaggcaggtggccagncatgac

SEQ ID NO: 17115 - DNA, 458 bp, Homo sapiens
agagtgcctagaggccaggaaagggagaaggtcctaccagcctggggtagggactcgggggccaggcactgsgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaagcaggtggccagcatgaccaagcctaccacaatcatcgaaaagaa

SEQ ID NO: 17116 - DNA, 308 bp, Homo sapiens
acttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgt

SEQ ID NO: 17117 - DNA, 91 bp, Homo sapiens
aatcaatcaattcagaacgtcgagatggagcccaactcactccagtgggtcggctcaccgtgtggcttgcacggacctttacattttctac

SEQ ID NO: 17118 - DNA, 507 bp, Homo sapiens
cattctaagtatcatttatgtgagtttgactactccagatacctcaggcaggcaactgacccctgcttcctgagccacctgggacttgaagttctaccactgtggctccaaagctgcccaactagaaaccccaaaaggcaagagaactcctcacccgaaaccagaagagggcgtatggctagagtttcaccctaagaagaaaggggaagcaggtggaaaagcaattaaaaaaaaatcagcatctctctctagcctattatctcctgttagacacagcccagaaaatgaatagagacaagtcctggctgggtctgggttcagaaacataatagaaggattcatctaatggaagggaattctttccacagttgctagttcctcacacctctgcctctatgggattctcctggtccccacatgctctgctgtgtcttctagctgtcggccactgtggaggaagtgaacctttctagatcctgctgactcatacaatgagttttgtgtgga

SEQ ID NO: 17119 - DNA, 426 bp, Homo sapiens
  misc_feature 324: n=a, g, c or t
gcatttagttgaagctgcaggggagtgagggagaggaggataggaagcaggaaagcgggagagctcgagggacaagggggctcggtgtgtttacaccaggcacgggctacgagcgtccatcccggcccctggcttgcgctcccgaagaggagagcaaggctgttctgggatccggccgtcgtgcggcaagaggcttgtctgtccgggttgccggaaccaggagaacccagagggaaaccgaggsaaaggagcggcgcgttttactagagagagcgcgagaaagaggcgagacaggagcgcgcgagggagcatcgagcgcggaangacatgagracctactggctgcacagcgtctgggtgctgggctttttcctgtccctcttctcattgcaaggactgcctgtttcgcagcgtggatttttaacc

SEQ ID NO: 17120 - DNA, 421 bp, Homo sapiens
aaactttacaacgtttacacagttttttaaaaagagactgtatacacttgatttgctttcaaaataaatarggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcct

SEQ ID NO: 17121 - DNA, 471 bp, Homo sapiens
attggccactgtgtsttaaactagtgtgcgtgcagaaaggatgtgaagagttaagaggcttttaggcacaaaaggatagatttagagcaggacaggcggtcttgaggaagggcctagacctatgatgtgggtgttgctgcttcagaaggctctgagtcctgagtgtggagctgctgtcagtggcgtgtgtgagtgagcgggaagttttgtcatccttttgaagtgtcctctgtcacttgtgtcctgaatcatcaggtgtgttgctgggcattgccatccgaaccgggagtcccctgagcctcaaccttgccgagcctgtctggaagcagctggctgggatgagcctcaccatcgcggacctcagtgaggtaactccctggggcggcaggcggggcctctagggtcttgttaacaggcacagtctgttctgcgggtccggtcaggctgtgaactctggcctaatctcagtgc

SEQ ID NO: 17122 - DNA, 452 bp, Homo sapiens
cttgtgatgaacttaagtgcgctataatcttgaacgtgaccatccactttgcctgcggattaattgttgtgctttgtattgagacactgctagtttaattttagcatggtgactactgaggccatgttttcttaagcattcaggtgatgaaaatgaggaaatggtgttgcaatatcaawksccgcgtgacccaaatggccatgttattttaacgacaggaggagtgacacagacaactggatgagggaggctgtaactgaaatatcacgtgggtgaacaaagggagaaatgtcgatggcagctgtgttgaccctttacaacatgcagcggattctgccagatcccaccaacaatcatgctttctacagtaaccaagtgctgcatccaatcatggcaatgaaaaacagttctcctaacttgtaaatactttgatttgaaaaaatggagtttca

SEQ ID NO: 17123 - DNA, 312 bp, Homo sapiens
aatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtgatcgcagcatgttgggaggctgaggagggtggaccacttggggccgggagtttgagatcagtctgggcaacagggtgaaacccgcctccactaaaaatacaaaaaaaaggaaaaaaaaaaa

SEQ ID NO: 17124 - DNA, 426 bp, Homo sapiens
aaaaatgctaaaggtagaagcaactggtagtcccgaggaagggtgggcgggtggagagccccggactggagctcctgcgaactccccttcctgccctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgcacgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtggagctgccgtcgggtgagcacgtttcccccaaaccct

SEQ ID NO: 17125 - DNA, 562 bp, Homo sapiens
aggatagcctgaagaaacgtctacaggcaaaagtcaaagttattgggccctttttgagattgaagaagagtgccatctcaagacaaatctagcttattctaagaaatatagactctaggcatcaagactactactggctactaggaggcccaggagtgtacacttcagtcattatgttgggaaattggggtcccagagcatcaactggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttacgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggtactcatgtcctcaagacgactcatgatgctggatatgagaatattact

SEQ ID NO: 17126 - DNA, 442 bp, Homo sapiens
actttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaactactcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaag

SEQ ID NO: 17127 - DNA, 505 bp, Homo sapiens
tataaagccaaaagacaatggaaaatcagaaaaatatgttacaaaaatatttgtgatacataaagaagctaaactactaatacataaagtattcctggaaatcaataagaaaaagattatcaacatagaaataggcaaaggataagaacagaccagtctcccaaacaggaattcaattgactcttaactatgtaaaaaacgcttgatcctacacacaataataataatacaaatgaaaactacattcagacatcctgtttcatttattagattggcaaaatccaaaagataataacacattttattggaaaagccatggggaaaataggcagtctcacagacaattggtgaaaatatacattggaatcctatggaaggcattttggcaatattcatcaaacttacaaatgcatacaacttttgacctagcaattccaaatctagagatctaccttgtggatatgcttgtacacaaacataaagtgtactaggctgttctatgcac

SEQ ID NO: 17128 - DNA, 379 bp, Homo sapiens
aaacatgaggatttaagtttggccgagatactgagcttcagcataatgggatatgtgactaaaaacagttggaaaaccacggacccacagcatgatttcagatgcatcaaaaatatgaaacacaaacaaataatcaagatgcccaacgcactgcagattcgtgtgtatttctgaagaggaaactgaccctaaggagttctggctgggtccacgttaggaagaacacaggcaaggatctgcggagggaggacagacctgcagccatagacactgggggraacacaacaaaatcaactgagtatgaagagggagagtgttttaaatcagagcaatgaaagaaagtgaaggagaaagagggggaaacccgggccaaggcagc

SEQ ID NO: 17129 - DNA, 415 bp, Homo sapiens
tgatcccctcagtaacgttggggcaatgccttgatgtttacttggttctcagatatggattggccatcaggttggcacaatctgtggctataaactggcaataagaaatcctctcccagccgggtacggtggctcacgcctgtaatcccagcactttgggaggccaaggtgggcagatcacctgaggttgggagttcgagaccagcctgaccaacatggtgaaacccgtctctactaaaaatgcaaaattagccgggcgtggtggcacatgcctgtaatcccagctactcgggaggctgaggcaggagaatcacttgaacccatgaggcagaggttgcagtgagccgagattgtgccattgcacttcagcctgggcaacaagagcgaaactctgtctcaaaaaaagaaacaaaaa

SEQ ID NO: 17130 - DNA, 547 bp, Homo sapiens
accggccaggatgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacagccagcgccctgacaaagccagcctctggataagaaactaattacttctcctgcttcttcagttwgacctcctaagggaagtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcttgaaga

SEQ ID NO: 17131 - DNA, 470 bp, Homo sapiens
  misc_feature 29: n=a, g, c or t
tttagctccagtcatagcaattctgtagnttcctcacatttactgtgtctttgtccacaaatgaaatatgttgtaaggtcagtgttaatttcgtgagacgatatagatgaacacacttgctcattttttgaaataaatatgcagatttaaaatgagtggcacatatatataaataggttattgaatgggtattctcttttccctttaatttaaaaagtgatatttatttattaaaaggagcattggtagaattattggtttatagtatcttctttaataatccttacaattacatatactaataggatgttaaaattatcatcgtgtttcctatttgtgtttagattcttataaagcatgagatgagtaatcaagggaagggtcgcatctccatgwttkccccatgaatagaatccatttgacaagccatttcatttcctttctggagaaagggagttgttttttttttc

SEQ ID NO: 17132 - DNA, 520 bp, Homo sapiens
atgtgtgcttctactagtgtgtgctcttttcactgtagacactatcacgagacccagattaatttctgtggttgttacagaataagtctaatcaaggagaagtttctgtttgacgtttgagtgccggctttctgaktagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgct

SEQ ID NO: 17133 - DNA, 371 bp, Homo sapiens
attatgcctccaagaagaggttcaactaggtgggctgcttagaatctagttttgtattatttggacttttgttcacattatcctttcaaaatacattttaaaaatactatatgcaccgaggtgggtggatcatctgaactcaggagttcgagaccagcctgggcaacatggcgaaaccttgtctctaccaaaaatacaaagaattagctggctgtggtggtgtgcgcctgtagtcccagctactcaggaggctaagataggaggatcacttgagcctgggaggtgcaggttgcagtgagctggaattgtgcaactgcactccagcctgggtgacagagtgagaccctgtckkcaaaaaaaaaaaaaaaaag

SEQ ID NO: 17134 - DNA, 510 bp, Homo sapiens
aaaaccggctggagttccgttttgcgatgtggtttcgttcttctttcgctctttgtaataaatcttgctactgctcactgtttgggtctacactgcctttatgagctgtgacactccccaggaaggcctgcagcttcactcctgaaaccagcgggaccacgaacccatcagaaggaagaaactccaaacacatcccagtatcagaaggaacaaactccagacacgccgcttttgagaactgtaacactcaccgcgagggtctgcagcttcattgttgaagtccgtgagactaagaatcctccaattccgggcacaggattatgctgcagtaacaaacaacccaagtcccakgagcttaaaacaagagtttatttttcaccaaaattatctatttaataatgcaggttggcaagatggagactaggggagggttcagctagttgtattttttcagggatccagggtgatggaagtttcttctcaacttttgtcttcaagatcatctgtggt

SEQ ID NO: 17135 - DNA, 476 bp, Homo sapiens
aggcgctggggctgtcctgggtcgtcatgcgagaaatcgtctcaccccagccagtgtgacggagtgagagcaaaagaaagttttgatagcagcgtacgatttatattcagctgtatgctgggcaggtccaacttsgcatttcttggctgtatctctgaaggaaagtcatcttaatctctatgagcctccatttcctcagctgtaaaatgggaagatcttcctcacactgctgtgacatttagtgagtgcctgctgtgtgtcatccattgtgacagtgttgggaacacggagatgaataaaacaaggcccctgtcctgggagagccgagagscacctgtcagctgacatcttagggaggacaccatctacatccaaccctgactactgaacacttccagtttcttggaagaaagattttaaaatcttcagaaatgagaactcctccaaataggattttcatttgtttcatatatttt

SEQ ID NO: 17136 - DNA, 474 bp, Homo sapiens
  misc_feature 121,123,334: n=a, g, c or t
gttcttaaaggcggcgtgtccggagtttgttccttctgatgttcagatgtgttcagtttcttccttctggtgggttcgtggtctcgctggctcaggagtkaagccgcagaccttcaggganangatctgagatggtatagaagtgtttgtrtcccagcagcaggtggaagccaggggatgtctaccaaagttgtaaatgcatgtattctgtggtgtagctgagagatagctgcctcacagagtatgccatggaaaattctaaggatgatgaggccagaccrctctgcrtggatccacagcagtaaatccrcttctgagaagaatgaaagccaangcagatatgaaagagccatggactgctgacctttgaaccctgagaggagtgcagagctcrctcrtattctaatgaagtatttttctrcccttrttrtgattctgactcactatrcttcttatcaaarttacatgatgagg

SEQ ID NO: 17137 - DNA, 447 bp, Homo sapiens
gtttctagagctcggaggctgctggtagggggaagttgtacccgtcagcacctgctgagggctttgttgtccaaaccctgacagggcaccactttcagataaaaacatagacctgaatggcatcatccagtatccaaggaaaccatgcttgcttgaagagtgagcaggtgagcaaagagacaagattacatgtttaaaccaagaaaagaatcttgaaaattttttacagacaatgggaagcactgacacctttaagagggatgtgtaatacactcgctaatgtttcctgttgtgtttctgaaaacctgtgtcagaaaatatactgtctcgaactggaaagatgtgagattcttaattttaaagagctccattaatattgaacagattggaagaatgcgaaatgttattagacacaggcacagcatagcagtagaaacatcttaactg

SEQ ID NO: 17138 - DNA, 346 bp, Homo sapiens
agtgtgcagccttcttcaaaatggctgccagcatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaasatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaaaaaaaaaaaa

SEQ ID NO: 17139 - DNA, 503 bp, Homo sapiens
aaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaagcctgcactgggctttatttgtctttttttattttttaagcactgcctgccagagatgggcctggggctgatgaggaccttagcgctgctcgttctcctttttctgttcatg

SEQ ID NO: 17140 - DNA, 374 bp, Homo sapiens
  misc_feature 279: n=a, g, c or t
attcttttcccccttctcaccggccaggatgcagacataatgatggcaggagctggagcagccacctgaggacccagagctcaaagccacatgttgagaagggcakagataactgtatccactctggactgctgacctttgractattatgttatttccagggaaatgcaaaccaraggatgtggtctctgatctaatccttagagaatgtgaccatgaagacacttttcctacctggtaaacaaaagataatgagaaaagtgaggttggaagttggtntactgagccaggagctataacaggtgctggagcaggggtcgtgatctgaatgaccagagggaaggactgatggaattggatggtgakagctccag

SEQ ID NO: 17141 - DNA, 250 bp, Homo sapiens
actttgctgctagtttcggttcgcggcaggccgggtgtagtctcggcggcagggcggagacactagcactatgtcggaggagcagttcggyggggacggggcggcggcacggcaacggcggcggaagaagaaccagtgaagaagataatggaaaagaaataccacaatgttggtcttagtaaatgtgaaataaaagtagccatgtcgaaggaacaatatcagcaacagcaacagtggggatctagaggag

SEQ ID NO: 17142 - DNA, 258 bp, Homo sapiens
  misc_feature 247,256: n=a, g, c or t
actttgctgctagtttcggttcgcggcassccgggtgtagtctcggcggcasggcggagacactagcactatgtcggaggagcagttcggcggggacggggcggcggcacggcaacggcggcggaagaagaaccagtgaagaagataatggaaaagaaataccacaatgttggtcttagtaaatgtgaaataaaagtagccatgtcgaaggaacaatatcagcaacagcaacagtggggatctagangaggatttnca

SEQ ID NO: 17143 - DNA, 169 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctgatgagcaaaaaaaaaaaaaaaaaa

SEQ ID NO: 17144 - DNA, 133 bp, Homo sapiens
  misc_feature 128: n=a, g, c or t
tataaagagaagtaagataatggcaaaattatggcatatataaatgttaaatcagggatgtccaatcttctggctttccggggccacattggaagaaaaattgtcttgggccacacataaaatacacntaaca

SEQ ID NO: 17145 - DNA, 144 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagct

SEQ ID NO: 17146 - DNA, 149 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctgatga

SEQ ID NO: 17147 - DNA, 147 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctgat

SEQ ID NO: 17148 - DNA, 144 bp, Homo sapiens
  misc_feature 138: n=a, g, c or t
tataaagagaagtaagataatggcaaaattatggcatatataaatgttaaatcagggatgtccaatcttctggctttcctgggccacattggaagaaaaattgtcttgggccacacataaaatacactaacactaacngatagc

SEQ ID NO: 17149 - DNA, 146 bp, Homo sapiens
tataaagagaagtaagataatggcaaaattatggcatatataaatgttaaatcagggatgtccaatcttctggctttcctgggccacattggaagaaaaattgtcttgggccacacataaaatacactaacactaacgatagctga

SEQ ID NO: 17150 - DNA, 505 bp, Homo sapiens
ttaagtcttatagtaaccataatgaaaacacatacattttccttcttaatactttaaacttttaattatgatataatttcaggctcaatgaaaaactgcaagaacagcattctgtacatattctacatgttacacacattctagtgacgagtctagagaaaattcagtgaaaaattcctctaaacttttcactgagattccccagtgttaacattttaccttattttttttattgttttctgtttctgaactttaaaaaagtaagttacagcagaggtgggcagatcatttgagcccaggagttcaagaccagcctgggcaacaaagcaaaaccctgtctctacaaaaactaaaaaattagcgaggcatggtggcacatgcctgtagtcccagccacttgggaggctgaggtgggaggattgcttgagcccaggaggttgaggctgcagtgatccatgatggtgtcactgcactccagcctggatgacagagtgagactttgtgt

SEQ ID NO: 17151 - DNA, 149 bp, Homo sapiens
tataaagagaagtaagataatggcaaaattatggcatatataaatgttaaatcabggatgtccaatcttctggctttcctgggccacattggaagaaaaattgtcttgggccacacataaaatacactaacactaacgatagctgatga

SEQ ID NO: 17152 - DNA, 114 bp, Homo sapiens
aaaaggatccgtctgaggcggcgacgagtgagtactcctgattgtgacatcacattcatcccctgggcgatggagcttgtcactgggaaggaatactcagtcggagaatagcct

SEQ ID NO: 17153 - DNA, 269 bp, Homo sapiens
attattgtttgaagttgtggtagtgtttggtcaactatttttaatggctccatgacattttcttgactgacagcagcaatcacagtcacattccacagcctctccagcacccagccagctctccgcgggggcagcagggactggtccacccaacaacagcagccatgtcctcacctcttgctacagcagtaactttatttgatttgatgtatatgaagaaataaaactcagaagtcaattgacttaaacatgcaaaaaaaaaaaaaaaa

SEQ ID NO: 17154 - DNA, 498 bp, Homo sapiens
ctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaaataactctgaagtaagagaaactgcaatagaagttggaaaaggatgtgatttccatatttcaagtcattcaaagacagatgagtcatcaccagtgttatcgccaaggaagccttctcatccagtcatggattttttcagttcacatcttttagctgactcttcctcaccagcaacaaattctagtcatacagatgcccatgaaatacttgtgagcgattttcttgtttctgatgaaaaccttcagaagatggaaaatgt

SEQ ID NO: 17155 - DNA, 449 bp, Homo sapiens
agtgtgtttataaaacacagtaatttgtttacttatctgtctcctctactagatttgagtgcctggttccctattgtgcccttaccatctagcatagtaccaactatttttgatacttttacttcctatgagttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtcaaaatgagcagtagtgtgatttcataccaagacttggtgaagtgtttcacattgatcatccagagtctacaacgtg

SEQ ID NO: 17156 - DNA, 356 bp, Homo sapiens
gagagagggccccgtcgcgaccgcgtccccttgggtccttgatcctgagctgaccgggtagccatggccttgcggctcctgaagctggcagcgacgtccgcgtccgcccgggtcgtggcggcgggcgccagcgcgtgagaggaattcatagcagtgtgcagtgcaagctgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagasaggtaccac

SEQ ID NO: 17157 - DNA, 515 bp, Homo sapiens
actttgtctagcagatctccggctctggattacttgttctccctcagagtcagaaattaaccttttcctgaaggttttttctttagttaggaggggaaaggcagtacctttgttttagctgaaatgatttggcagcttacttatttttaggatggttggtgttgacacataaggggtagtgtagtctgtcaccttgaggccagggaccacatctcattaatagacggtacacttgcagttgacctcatgaggagctgtgcccactctgtgcttgccggtcaaaaacatatgaggtgtgtttttcatcgcttcagccaggacagtattctcgcagtcttcagccttaactaaagagggatgtctcctggggctgcccagcaaatgtagctcttcaaggaagttatttgttttgtccgcagttccagctggtagtcatgagcccagtcaggtcatccccatcaaggatgtacactctggctaatagaatagaatttcctgatgtaaaaaaaaaaaaa

SEQ ID NO: 17158 - DNA, 576 bp, Homo sapiens
attttcctaagctatgagaacaattagaggaacagattcatgcttgtatcttgcattcagaaaacaaactgtcctactaatcaaagctgcatatctcatcagagataatggttgaattttattgcaaccatattggcaatctgaaactggcaaacacaaaggattgttttcactaggcttaccattttgctttgcttttttaacacactgagccaaagatgcagtgtaattattgggcttttgccttatgttgagttcagtgtaagcatggaagctagtgattctgaatgatatatatatccattgcatgttgaactcctttagaattttgttcttaaacaaacttagaatttcaaaagaaaaacatatgatccattaagttggagtgtttatgattattgctagaaagaaggcagacttcatattctcatcgcccatttttcaaacttgtacattgatctgtacattattttaagccacatgtttgtaattgtttaaaacaaagtggaaacattacacaatgtccttaataaataggcccatgtaaattttaattacaattaataaatgatcaaa

SEQ ID NO: 17159 - DNA, 441 bp, Homo sapiens
aaagattccaacttcctgggcagagggtcatgtagtggaatagakctgtacctggcttcaggcgagacttggagctcaaaactttcagtaggacagccaggcgcggtggctgatgcctgtaatcccagcactttgggaggccgaggtgggcggatcacgaggtcaggagatcaagaccatcctggctaacacgcaactccaaaatggaagtactattgttatctccgtttacaaattaggaaactgaggcacagatatgctcttgggtacttgtcagcagcagttgttctacaagctaaatatctggatatcttaaatctcagatgagcatcttagcctctggattactgcccaatgaggaaagctatgaaatgcatggataacttgctaatcagtatttgccatatgtgctagcagcatcagcatcarttgggagattat

SEQ ID NO: 17160 - DNA, 502 bp, Homo sapiens
agtgaagattccaacttcctgggcagagggtcatgtagtggaatagagctgtacctggcttcaggcgagacttggcaactccaaaatggaagtactattgttatctccgtttacaaattaggaaactgaggctcagatatgctcttgggtacttgtcagcagcagttgttctacaaatgagcgtcttagcctctggattactgcccaatgaggaaagctatgaaatgcatggataacttgctaatcagtatttgcaatatgtgctagcagcatcagcatcagttgggagattatggtggcctccatgtcagacctcctaaatcggaatatcagagaaggtggcccaggttaccatgtttcatctgccaatgcattgaaaacttggaatgtaaattaattcaaccattgtggaagatggtgtagtgattcctcaaagacctagaagcmgaaatatcatttgatccagaaatcccattactgtgtatacacccaaaggaatata

SEQ ID NO: 17161 - DNA, 417 bp, Homo sapiens
  misc_feature 336..337: n=a, g, c or t
agcggagccsctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcaganncctgccaaaaccatggaggaggctagcaagcgaackaccagttctgggatacgcagcccgtccccaagctgggcgaagtg

SEQ ID NO: 17162 - DNA, 416 bp, Homo sapiens
acatactaagttaggttgcagttccctacatagcaactcagagtagggaggaaattttaggccaaatttaatttaaattatgttggagcatgaccaaagttggtcatgaccagaagctgaacacagatatggaagctaacacaatatccagtggagagagattgtggtagagtacatggggcgaaatggttgatttctgcatttttgttggtgacgccatcaggatttgctgaagaaccaaacgtgtgacaggaaaggacaacacaaggagctgccagctttggaaaccagttctactctcagtattaccttcgcaaaagatagagctttgtaaatttctagattcctcgttcttattatcctagactatttaaccagaatctccagggtcgtggtcctggaaacaatacgtttaa

SEQ ID NO: 17163 - DNA, 520 bp, Homo sapiens
cttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaatagttttgtagactgaggatctcattattttacagccttgaattatgtcctgtatactctgttaaagaaactgggaaaaaaatgccaactggttgtttctgggtggcggaattatggctgtttcttttcttttttaatttctatagtaagtttgaataactttcataacatttaggaaaaaatattaaaggaaagaaaaaagatcagggaatttaaatatatttttagtagatatttttatccaaacttaattcttagaattgattagamcacatagtttaccagaaaactcagctgttcaa

SEQ ID NO: 17164 - DNA, 501 bp, Homo sapiens
acttgttggcctacagaggtgtggcaagcagagcacctcagaactcaggcgtactgcccgccgcccgagccctgcgaggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccscagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctgatcttcccttagtttctcctcttctgagggcatgtggagagcaggtttctgagcttggcttggattcagaagtgctgcctgt

SEQ ID NO: 17165 - DNA, 474 bp, Homo sapiens
cattctaagtatcatttatgtgagtttgactactccagatacctcaggcaggcaactgacccctgcttcctgagccacctgggacttgaagttctaccactgtggctccaaagctgcccaactagaaaccccaaaaggcaagagaactcctcacccgaaaccagaagagggcgtatggctagagtttcaccctaagaagaaaggggaagcaggtggaaaagcaattaaaaaaaaatcagcatctctctctagcctattatctcctgttagacacagcccagaaaatgaattgagacaagtcctggctgggtctgggttcagaaacataatagaaggattcatctaatggaagggaattctttccacagttgctagttcctcacacctctgcctctatgggattctcctggtccccacatgctctgctgtgtcttctagctgtcggccactgtggaggaagtgaaccttctagat

SEQ ID NO: 17166 - DNA, 477 bp, Homo sapiens
tatatcaagcaaagaaaagtgtggacacatccatgcacactggagaagtagcagagtggtttaattttgtgttggagaatcaaaggccagaatgaaaaggcactttttacatcccaaaggaaaattcccattcagaaagacattgatggcttttttagcggcatccattcatctgctctgcaaaggcatggggtcatgtgattttgagagtactgactctactcccaatgcatagcagtcatgtataataatttaggggacagtgattccattcacagttccagaggtaaacccccctccaattgactaaacccaatcagaaaatcctactcttgcataggattgtttcagagataggcacaaatctcatcctaagccaatcagagcacagcacttccgtcggccatggtgattgattcagagatgggcatgtgactggtttgctcagttagagtgaaacctaggattttttgtttg

SEQ ID NO: 17167 - DNA, 626 bp, Homo sapiens
tatatcaagcaaagaaaagtgtggacacatccatgcacactggagaagtagcagagtggtttaattttgtgttggagaatcaaaggccagaatgaaaaggcactttttacatcccaaaggaaaattcccattcagaaagacattgatggcttttttagcggcatccattcatctgctctgcaaaggcatggggtcatgtgattttgagagtactgactctactcccaatgcatagcagtcatgtataataatttaggggacagtgattccattcacagttccagaggtaaacccccctccaattgactaaacccaatcagaaaatcctactcttgcataggattgtttcagagataggcacaaatctcatcctaagccaatcagagcacagcacttccgtcggccatggtgattgattcagagatgggcatgtgactggtttgctcagttagagtgaaacctaggattttgtttggtaattgagataaagacacttttcttcaggaagatgtggtgtacggaactgttccagacattttgtcaccatgataaaagtgagtctgaaaagtaaccatcatgttcaggaaggcaaatcaacagaactgcagagcaatggagtcagcacc

SEQ ID NO: 17168 - DNA, 473 bp, Homo sapiens
tttgaacaactgaggttaagcaaaagcacggaatcatgaaaattattctttgaaatggcaaagatttctatggctggatcatgggatttattgactggagcgatttctcctcagaagaccagacacatgtgagctatgcgaatccacggaagtgttgttatctttctattttttcctcgcttatatgaaggactataggtcaggaactgtgcaagaggaggaatgtgcatatgttggggtggggatagataggggaggtctggaatggataaatcatttcaaactcaaaaaagcagactgagagaagacatagggagaactgacagagaaaccataaagctggaaaaagattagagaaaaccacaagaagatctgtttaaccctaatttctgtgttttttctgatgaagatgtagtattaattgtttcagagttcatcagagatccacgtatcttaaatctgagatataagcc

SEQ ID NO: 17169 - DNA, 396 bp, Homo sapiens
tttgawsaactgaggttaagcaaaagcacggratcatgaaaattattctttgaaatggcaaagatttctatggstggatcatgggawttattgactggagsgatttctcctcagaagaccagasacatgtgrgctatgcgratccacggaagtgttgttatctktctattktkkcctcgcttatatgaaggactataggtcaggaactgtgcaagaggaggaatgtgcatatgttggggtggggatagataggggaggtctggaatggataaatcatttcaaactcaaaaaagcagactgagagaagacatagggagaactgacagagraaccataaagctggaaaaagattagwgmwaaccacaagaagatctgtttaaccctaatttctgtgty

SEQ ID NO: 17170 - DNA, 506 bp, Homo sapiens
atcatcaatcagtaagtcccttccacattaagaactaaggctcaaagagaagtataagactaggtctttatatttgtaagttacttacactctagatatcaaacgaaatgtaactcacatgaagtgcttcaatgctgaatagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaaygaaaaagctcaaaaaaaaaaaaaa

SEQ ID NO: 17171 - DNA, 564 bp, Homo sapiens
atcaatcagtaagtyccttycacattaagaactaaggctcaaagagaagtataagactaggtctttatatttgtaagttacttacactctagatatcaaacgaaatgtaactcacatgaagtgcttcaatgctgaatagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagtccttggtccaatagaatggaatcttaagtctcaatcaaaaggaatcatggaaggagggttgagatgagagggaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagct

SEQ ID NO: 17172 - DNA, 431 bp, Homo sapiens
acttacactctagatatcaaacgaaatgtaactcacatgaagtgcttcaatgttgaatagtgaggaacgcacagcggaaacatattcttgcagcccatcagatcatccacagttacacggaaaagcatggttcaaaagaaattaactgagggagagcaagatgaggcctcaatgctgccatgttacttgagaaagaaactcaaaatgagaacaacagctaagtccttggtccaatagaatggaatcttaagtctcaatcaaaaggaatcatggaaggagggttgagatgagagggaagattgtgatttttttgtaaaagaagctgtacgaatcatcataaataattccaatagtctgcacttctcccaaggtgtgcactgctcataaacttgccagtgtgtgattcatgagaaaggagatttattttcctt

SEQ ID NO: 17173 - DNA, 407 bp, Homo sapiens
  misc_feature 316..317: n=a, g, c or t
atrtttgwaagttacttacactctagatatcaaacgaaatgtaactcacatgaagtgcttcaatgttgaataggttggtacaaactcaagtgcgactttcagaatgaaaatttttctattactttggcacagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagnnctgtacgaatcatcataaataattccaatagtctgcacttctcccaaggtgtgcactgctcataaacttgccagtgtgtgattcatgaga

SEQ ID NO: 17174 - DNA, 347 bp, Homo sapiens
  misc_feature 314: n=a, g, c or t
aattaatttgaagttaaaattattgttttaagtactgtcaagtatatcttcaggcaagaatactcaaggtagtatttatattttataagttttgttttttttttttcctcagacctcatgatttctagtgacaaggtactttgtgaatttgtattaacttgaaatttcactgcaactgaattagctaaatacctttcaaaagaaatgactaagcagccagaacagggatagaattacaaagtttycaagaaagtgcattttraacaactaggttcaaaactattttycttacactaaaaktagggaacattatnatwattttaaacatttgaaaatgaggttaataa

SEQ ID NO: 17175 - DNA, 477 bp, Homo sapiens
aaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttgaatgtcaagcgagggagccttgagtgggaactggccctccagccctaagaaaacgtcactctcactctgcagtctcaaactatgcccccatcagggatggaatggacactggaggctttacaaaaggcagatgcccacctcagtgacttctaaggactgactctgccagcctggccttgactccggttacacagacatgggggtgaactttcactccasctccttccttcaagtacatactgaaaattcagtcag

SEQ ID NO: 17176 - DNA, 853 bp, Homo sapiens
cagaaatgttcactatagcatcacatagggtaatcaaaaaattaaaaataacctacatgctctcaaagtaggaggaatggttaaattaatagttgattttgctttgtctctcttggtttcaaggagtagaaattctaactagattaagtaaaattgggctttgttgaaaagggtaaaaggtgctctaataaccccaaacagcaagatcactgaggccttttggcagtggggagccagagctactttcccatttcacccgttcagggaccaggctagtcactgcttcttcctctgtagacctgctttgttctcagcttcttcttcagccagtcttccttgtacatggctcagtgttgtttgccaccttggacttactcagtttttgttaaaattcacatatttccagaacaggaatctgaaagagctgttctttttgagccttaggtgggtcagtgaacaacctgtggtttggtctttttcttcatccccttccagggggtctgtatttaggtttagatagctagtgaaaatgaaatggcactgggtaatgacattgattcaatacatcttggctaggcacactggctcacgcctataatcccagcactttgggagactgaggcaggtggatcacctgaggtcaggggtttgagactagcctggccaacatggtgaaaccccatctctactaataatacaaaaaaactagctgggcatggtagtgcacacctgtaatctcagctactctggaggctgaggcaggagaatcgcttgaacccggaaggtggaggttgcagtgagccgagattgcgccattgcactccagcctgggcagcaacagtgaaactctgtc

SEQ ID NO: 17177 - DNA, 498 bp, Homo sapiens
tttttatcactgaagtctctgttcgtcttttttgggagtcctcctgaccatccgacctaaagtgatgtaggacttttaggggcagaagccattccaggcagagggattatgctggtcctcatacatggaacaagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccaggcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaactggtaataaaaagttcttgaaaaaaaaaa

SEQ ID NO: 17178 - DNA, 142 bp, Homo sapiens
tgttaccaatgtgtatcgtctccttctccctaaagtgtacttaatctttgctttctttgcacaatgtctttggttgcaagtcataagcctgaggcaaataaaattccagtaatttcgaaaaaaaaaaaaaawtgcgaaaagc

SEQ ID NO: 17179 - DNA, 571 bp, Homo sapiens
ttaaggacgattgtaaaaaaaagaaaggaaatatgtgaaccgtcactgcagttatgctagcaggcatgaaaaccttgtactttttgcaaaatacatttttatcttgtactgaaaatgcagcctttatgtgggtgcagggttattataagaaaggcatacttttgactcacatatgatttgagaaaaaaatgaagacattgtatgacaacctaaaccaaaaggaaggtgaaagatctgaagctgaagaatttaataccagcaaaggatggttcgataattttagaaagatttaaaagtcaagataacaggagaagcagcttcagttgaccaggtggcaacagtgtagactccattaagaaaatcattgagaagaaacaatatctgcctgaacaagtttttaatgcagataaaagtgacctagtctgggaacgaagaaatgccgcaaaggaaatttactggtaaggaagagaagtgagctccagcaattaagggagggaggaataggctaactccagtttttcacgcaaatgcagtcagggttatgactggaactgccttatctataaagcag

SEQ ID NO: 17180 - DNA, 165 bp, Homo sapiens
agctgtgtatgtctcataaatactgaaaacatatcctaacatttggaagcagccaagggaagctatggtgattttaattcaaatttaaatacataattagtgagtgagcgctcagcaatgatgggaatgtactagaatgatagcaccagtggtgcggagtcagag

SEQ ID NO: 17181 - DNA, 433 bp, Homo sapiens
ttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaaacatatccttaaggggatatggcccctaggcctcattttccttttctgtctgagcattaaaaaaagcattaagtaaattccacaaattctttggaatacctagagataaacagatatcatgttaaactgtatgat

SEQ ID NO: 17182 - DNA, 159 bp, Homo sapiens
gattagtctgtattttccggttcaagtgtatcttgtttttcgtttgctccacttcccttgtcccttgcaccccactaacaggaaaattcctggtggtcaaaatgaaaaaaaaaaaaaaaaaaaaaaaaaaaaaaaaaaaaaaaaaaaaaaaaaaaaaaa

SEQ ID NO: 17183 - DNA, 109 bp, Homo sapiens
gattagtctgtattttccggttcaagtgtatcttgtttttcgtttgctccacttcccttgtcccttgcaccccactaacaggaaaattcctggtggtcaaaatgaaaaa

SEQ ID NO: 17184 - DNA, 137 bp, Homo sapiens
gattagtctgtattttccggttcaagtgtatcttgtttttcgtttgctccacttcccttgtcccttgcaccccactaacaggaaaattcctggtggtcaaaatgaaaaaaaaaaaaaaaaaaaaaaaaaaaaaaaar

SEQ ID NO: 17185 - DNA, 110 bp, Homo sapiens
  misc_feature 110: n=a, g, c or t
gattagtctgtattttccggttcaagtgtatcttgtttttcgtttgctccacttcccttgtcccttgcaccccactaacaggaaaattcctggtggtcaaaatgaaaaan

SEQ ID NO: 17186 - DNA, 354 bp, Homo sapiens
gtagccaaggaagaagagaagagaggaaggacacgcccattaaccaaaggacccaaaacatatctcaaggagctcatgaagtcatcctcatgcacacagtttcccaggtgtcagatctgtttgggccacaaacctaagaagaacatcatgtgaggatgaaggcagagagcagggtgatgcagctgaagccaaggacactgaagacttcctgcaaacccccagaagctggggcagaggccctccagtctccagaagaggccaaccatgctgataccttgaccttggactcctagccccagaactatgagaaataactttctgttatttaaaaaaaaaaaaagaaaaaaaaaaaaa

SEQ ID NO: 17187 - DNA, 339 bp, Homo sapiens
gtagccaaggaagaagagaagagaggaaggacacgcccattaaccaaaggacccaaaacatatctcaaggagctcatgaagtcatcctcatgcacacagtttcccaggtgtcagatctgtttgggccacaaacctaagaagaacatcatgtgaggatgaaggcagagagcagggtgatgcagctgaagccaaggacactgaagacttcctgcaaacccccagaagctggggcagaggccctccagtctccagaagaggccaaccatgctgataccttgaccttggactcctagccccagaactatgagaaataactttctgttatttaaaaaaaaaaaa

SEQ ID NO: 17188 - DNA, 323 bp, Homo sapiens
gtagccaaggaagaagagaagagaggaaggacacgcccattaaccaraggacccaaaacatatctcaaggagctcatgaagtcatcctcatgcacacagtttcccaggtgtcagatctgtttgggccacaaacctaagaagaacatcatgtgaggatgaaggcagagagcagggtgatgcagctgaagccaagaacactgaagacttcctgcaaacccccagaagctggggcagaggccctccagtctccagaagaggccaaccatgctgataccttgaccttggactcctagccccagaactatgagaaataactttctgtt

SEQ ID NO: 17189 - DNA, 491 bp, Homo sapiens
aaactgccctgcgcctccgctggcccgcgtgaamcctctctgctgcctcgactgactgtcgtttccgtgtcttgattgtggcctctgcctctcccccttccgatttcgttcgacttctttctacagttactaagcgcccactgtgtgccctggaagggactagactcagcaggaaaaacatccaggcaagtggacagcatttgcaacagcccagcaataagaaggaccatattctacttgggaaaaggtaaagtcgtttcatatggacggagcctgccaggaaacctgtcattcaaccctttgcaataaaacagctcctcatgaatgaagcaaaataaatcagaagttgtgggcttttaaactcactaaatgaaagcacagcatgcatgcagcctccctccaaattaatcaccagattaaatgcaagatgtgcacaccaaatcaatagcttgtgacggggactcctgsctgtgcttcaggaaattccattt

SEQ ID NO: 17190 - DNA, 375 bp, Homo sapiens
aagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaagkgyctttgttwaaaattacttggtttgkgaayccatctkgcttttyccccattggaactagtcattaacccatctctgaactgg

SEQ ID NO: 17191 - DNA, 450 bp, Homo sapiens
accacacctggaactgttgaacagctctttcttgctctgtgtctcattcaaatttgacagcctttaatgtcacctgtaaaacatattcccaaaggtagaatatgttttctccaagtctgaggaggcctaccagatgagctttcttatctgctgggcaagaatttctccttttctttggaggggatgtctagtcatgcttctgactaccaaaccactaaagatctcactgatattaggactctgcagaaggttttgtttgtggaaaggcttttactgctgaaagtaacagtaggacattctatggaatacctgaccagtactccttgaaacttcagtcatgaaaaacaaggagagactkagaaactctcaagaaccagaggagaccaaggagacacaaacaccaaatgcaatgtgatatcctgggtggaatgcaacggaaaagggacctta

SEQ ID NO: 17192 - DNA, 527 bp, Homo sapiens
tcatagaaattagggtagatttttatttcaactactactggagaatttaataaaaggcattatttgaaaagtttttctaacatagatttagggtttttrttttttagagtggacacactacatttaaaagcaattattttgcwattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatggtcttaacatgagaattggaatttcatgatgtkkggttccatttaawagcgggacaccaccccaatcycatggttttcctggttaccctaaaacagttggaaggaaactggggtgtttggtagacttctaaatcatgggtctctggamaatttggaatctggagattctcacctccatttactaaagaatcggggacttaattcaaattkgcacagtaatcagtaaagg

SEQ ID NO: 17193 - DNA, 443 bp, Homo sapiens
gttgatgtgaatgttctttatgttctacataataccagtcacatgtaggtraatgataactkrraatgtggcaaatgtaacaggagcttctgcttccacccaagatgaataaattgggacaaagggattgtcctcatgctataaacaactagaaaaatgaaaaaaaaatgtatgaaacaacagttccagatgttggagaaaggacagaggaggatatgctgccagagaaaagtctccacagtaaacctgctggaatgaatactattatttactcctcattttgcagagaagaaactggaattttagcgagtcctttctgcccttccccactggaaagacctaatcatttaaccacaaaactgargcagaggaactttcgcaattgaactggcaagaattattttaaatacatggcattaaacttcaaaaaaaaaaaaaaaaaa

SEQ ID NO: 17194 - DNA, 519 bp, Homo sapiens
attttattttatctaacataattatttgtaattgacaccctcgttcatttatttaaagcctaaacatttaccaatctcctgtgtgtactgactgcctttttttatcattgaatattttctggtaaatattttattgtggaatcaactttagagatttttgtaagaggctttaaagcagttatgatcgttagtactgttttcttgacggcaaaggatgggcgcttactagaggaccacttttcctaaatgcacacttcagattgatcataatttataattctgagttcctttgcctaattactggaatgaaaagaacattgaaatcacttgctctaatctcttcttaaggcagaaatcagaaagaatacgaggttttgttatcaggatgattgctagcctcatagaatgagtttgwtgagaagtccttcttcctcagttttttggaacagtttcagcaggattggtaccagctcttctttatacatctggtagaatttggctgcaaatcatctggtctgg

SEQ ID NO: 17195 - DNA, 319 bp, Homo sapiens
cagtgtcctgggtgtaaacctctgcgagatgcccctgggtgtcaggtcctggctgcaccccatcgttaggactgggggcagcagcagatgagggaagacttgtctcctctggcccatggagtgtccctgtttttcagctcagccagcatcccatactcaattctgccggcgagagctgtgggcctgttttgcaggttgtgtcgtttcagcgggtaactggtatgtgtgtgcatgcgtgcaaaagaaaacatcaaaatgtttggggagttggttgctattgtaaaataaaatatactgttttcaaaaaaaaaaaaaaaaa

SEQ ID NO: 17196 - DNA, 348 bp, Homo sapiens
aaaagaaccagggctgagctgtggagggaaggggagccatttctctccaccgactgcaacctccgtgctcacagctcacggttcaccagaatccaggggcttggtcggcctaggaatccacaatgctggatattttcatcctgatgttctttgccatcataggcctggtcattctgtcctacattatctatctgctctagtggcctggagctgcggccggagcctgctggagaacagctcagaaggaaggatggagctgaatggccgagtgccctgcttgctgacgcaccggtggatttttgcttctgctgttatctcgggtattgattccaaaaaaaaaaaaaaaaa

SEQ ID NO: 17197 - DNA, 565 bp, Homo sapiens
gttccgagcatgtgctggcagttgctctttggagcacccacttcacttctcccatgtagttcctgagtgcaggactctcctgaagaaggggcttctaaaaggccagcccatgcatcttgttcagaccaggctgctccatctccgctaagcccagggatccacttaacctcgtcgcgacatttctcagaagccatgacatgtccctgcggctggaggctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttraagtttctctc

SEQ ID NO: 17198 - DNA, 54 bp, Homo sapiens
aagaaagttctgggaaaccgactcccgggagcagggaggaacgcgcgctccaga

SEQ ID NO: 17199 - DNA, 430 bp, Homo sapiens
agcgcccgckkcgcggcgtccccggcccaaccatggcgtcctccgcggccggctgcgtggtgatcgttggcagtggagtcattgggcgamgtggggccatgctgtttgccagtggaggcttccaggtgaaactctatgacattgagcaacagcagataaggaacgccctggaaaacatcagaaaggagatgaagttgctgggagcaggcaggttctctgaaaggctccctgagtgtggaagagcagctgtcactcatcagtggttgtcccaatatccaagaagcagtagagggtgccatgcacattcaggtgaatccgccatactacatcccgctggttgagctgggtcccccacccggagacggcccctacgacagtgggacagaacccacgccctgattaagaagattggacagtgccccatgcgagt

SEQ ID NO: 17200 - DNA, 248 bp, Homo sapiens
agtttctaaggatcatgtctgcgagccaggattcccgatccagagacaatggccccatgggrttggagcccgaagcgtcatcgagagtaactggaatgagattgttgacagctttgatgacatgaacctctcggagtcccttctccgtggcatctacgcgtatggttttgagaagccctctgcccatccagcagcgagccattctaccttgtatcaagggttatgatgtgattgctcaagccaatctg

SEQ ID NO: 17201 - DNA, 401 bp, Homo sapiens
agttctaagaaaagtctggcaaggccagcaggaagttcatgagccaaagtcaccggtcagtggagtcctgcatctcccaggaatggacctactttatattcctgctacactcagttactgactggcagcagcctttgggaagcatggcctagaaaatgcagggatggatttcctaggccagcagctgggccttggataattacactccctgcagttagaaatctaaaagatgcatattcatggtcacctcaaaaaaaaaaaactataaagaacacacacacaaaagtatgtgattctttgtggataaattattttaaaacatcagcccagcctctaaatgaggttccaggaagaaacagactttttggaagctgaatagatcctagagctcactatttcaa

SEQ ID NO: 17202 - DNA, 364 bp, Homo sapiens
arrysgsmkgrarccgcckggagysgmckssrsygrrssccgsmgwsgcscskrswsrcrcmksmwswmmymrsmkykrstcasckykggkmacmtcwstgamyrymasygwcysymaryytcyskyrmwkycyrkyrsrgmccmwcagsgmcysrsagsryskkgsrgrwywkkgcsratskkgrmmwmkkgsrrratsrygmmssmygaskrmssmcsastrmssascmmymmmsagsyascawkmskyrrcakwsctyswymrasmkkskycawsrkgskccmysrkgskscyccwggsccccgccagcagcaggcaggtgccaggctggggtgctgcagtggcatcttggggcatcttgg

SEQ ID NO: 17203 - DNA, 414 bp, Homo sapiens
tagaaattttttacggttcaacatataaaaagctatgcaacagataaaaataaggcaattattaatttttaaaagtatgtttaaaaacatagtatactagttagccctagaaactatactaaactatatttatgtagccataaaaatgtaaatactatgattatgattgctaaaacatcagtgggggggagaggatagtagagggagagttaaatcctcatctaccataattagaagttattaatgtctaaaatgaaaaaataaggtgcacatattatataaatatgggacatatatatatgtatatatcagaagagttagctaaaagttaaaaatatttgcctctatggttggggggaaagtggagggttatagcatttttatatactttgagtatttgcattactttgctag

SEQ ID NO: 17204 - DNA, 398 bp, Homo sapiens
atctaggtgaccatggatgggagctgagcttggaggaggacgcacagctgtggggtggggtggtgaagagttgttttgagggaaaaggcccacaaagagaagcccaaccagccagcccccaggccgccccgccaggacccaccaatgaggcacagatggcagccgctgccgcmamtagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgccacctggctgtgctggcgtgtacttcacctgtccgctcactggggccacctgaggaagga

SEQ ID NO: 17205 - DNA, 369 bp, Homo sapiens
atttttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccttcagaatgcagtgaactgcgagagcagggaatgagagagaaattaaaccgtttagcaaaaaaaaaaawtaagagacatgatggaggcagaaaataaattgtaggggggagggaaaaaagcgttacaaaaaaaa

SEQ ID NO: 17206 - DNA, 465 bp, Homo sapiens
  misc_feature 142: n=a, g, c or t
atttttttgacgggctcccgctgggattcgggtgtctgctcatctggaagcctccatgctggagaggtagtcagcacagcgcacgcagggcktaggcgtgttttctcgtccctccctcgcaaccacagtcccgctcaaggcntgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggcaccgaggccsggggagctgaggggctcgggaccctgcgagccgcttaagaagaaaggaccgcaagaaccgaatgcagtgaactgcgagagcagggtaatgagagagaaattaaaccktttagcaaaaaaaaaaaataagagacatgatgggggcagaaa

SEQ ID NO: 17207 - DNA, 580 bp, Homo sapiens
aaaactttagttagtagttggtcccagtcagtaacactctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggggcacctcaaactcaactccaaaattgatctaatgaactttcccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcggaagacagtagagagtacagagcctggactgtgactcagaggatgagcac

SEQ ID NO: 17208 - DNA, 450 bp, Homo sapiens
attaaactttaatgggtaactagtagacagtaacactctkggagggctcaaaccacataaccaaatgtkccaagataatcctgagctcastattgtcagtcctgaagattttcctcagataatctttcatctctttgttcctgagastatatattagaggattacagagtggtgttatcacagaaaagaacaagagaaccagagtcactccacgagtcctgcctggggccccatgaaagtggccaacaatgtcactgagtttatattcctgggactttcccaagattctggaatgcaattgatgttctttgccttatttstcststtctacgtcgtgatcatgtggatttttatctgagatctacaacttatgaagaatacaaatgatgtatattcttttctactcttcatgtatggactagaggggcttgcacagtagtaagaaaaaaa

SEQ ID NO: 17209 - DNA, 510 bp, Homo sapiens
agtaacactctgggagggctcaggccacatcatgaaatgtgacaggatagccttgaactcatcaattgctgggggcactcaaactcaactccaaaattgatctaatgaactttcccaaaccacattcccttcttgcatttctgagagaatggattcccattcatctgactacagtgctaccctgaaagcagatccagagactaagattcacctgcaggtgattcatttgggtctcaactcaagcattcctttctcaagaagccttttgtggtatgaagagtgagacagagttccctgcgccacctccattgaatcatgttaggccttaatgtacctttcctttataacacttactgaatgattaatttggcatttatttacctggctattttattcagtgtttaggatttatactagattgtaagctcctcaagagtgttccaggtctagtttaggtcaccatgtatccctgattagtaccacacatcccagtgcaccatggttctcaac

SEQ ID NO: 17210 - DNA, 478 bp, Homo sapiens
cctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgcca

SEQ ID NO: 17211 - DNA, 462 bp, Homo sapiens
attactgctgggagaagctgcggcgtgcggaagtggacttggagcgagcgtgtgtggtacaagctggacgagctgtttgagcaggagcgcaatgtgcgcacagccaagacaaaccgcgcgggattgctggccctgatgctgcaccagacgatccagcacgatcccctcactaacgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccctcgacatgttcagtgcstggtggggctgcggagtccactcatccttgcctcctctcctgggttttgttaataaaattttgaagaaacaaaaaaaaaaaaaaaaagg

SEQ ID NO: 17212 - DNA, 447 bp, Homo sapiens
acttagctgatagctagcattagctgctggccaggtgcataagccatcttagatgtccagcccaggttcatagaatgggatgcccactgatgacaatgccaggccctccagggaaacgaggtaagagaggccgaagaggagaatctggtcctcctggacagcctggtcctcagggccctcctggtccaaaaggcgataagggagaacaaggtgatcagggacctaggatgstgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtc

SEQ ID NO: 17213 - DNA, 373 bp, Homo sapiens
  misc_feature 68: n=a, g, c or t
agttagctgccttggggaggggaggaagaccaccagagcccaggacgatctgctgtgcagatcatganccgtcgccgcagtgccagacagactcttcatccggaccggccgtcccactgggtcccctcaggaaagcgcagaagccggggaccccaaaccgcgtccagctcctcccacccgcccttctcggagccgcgcacttggtaacttgcgtgtgaagaactcacggccgtgttgccaggaaactgcggggagcagcctttgtggtctcacatatgcgtaacataataataaataacggttaacgtgataataaataaacaaataacaataaaaaaaaaaaaaaaaaaaaaaaaaaaaaaaaaaaaaaaar

SEQ ID NO: 17214 - DNA, 423 bp, Homo sapiens
ctccgacccgccccgsgsgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgcctgcccaccgcccaccamactctggggctgcctgttgggcaaacatatstacstctccacccgaattgatggcagcctggtcatcaggcsatasactcstgtcaccagtgatgahgatcaaggctatgtggatcttgtcatcaaggtctacct

SEQ ID NO: 17215 - DNA, 404 bp, Homo sapiens
acgttggaacggaacgtggaggtggccctggccggggaggaggggcggcggcgaatgctgggagagtccgacgagcgctgcactaacgcaggatccggctgccgaagtcctcgccagcaggatgaagttaaagggragtagatcgtacagccatgcaggcatggagccctgcccagaatcaccccatttacctagcaacaggaacatctgctcagcaattggatgcaacatttagtacgaatgcttcccttatctaagaatagaatctttaaaccattctgtggttatatcatttttagttaaagtttttaaggttttattctgtttatcgtgtgcaggaaagaaaaaaatggtaccaggttaaactttaaactttattgttgtgcagattatttcagtaggaa

SEQ ID NO: 17216 - DNA, 439 bp, Homo sapiens
  misc_feature 403: n=a, g, c or t
aaaaactaaaccggagcactggccatatggttgtgatcaggtgggctgcagaggaaggaatcattacttgctgaagcatagccagtgcaccaaggagaggaaagcagataggcagaaaagtctgctgtgttcagagccttagggaggtctggggagttgagggatatagacagggtcacaggctaaaatgctaggccttgttcaagcttccaatcgcccctggaaatgggaaccagggacactcaccgctgatggggttggtgcacccagcacacttcttggcatacaagtcacagaagcagttcaggcagtaggcaaagtcatcgcgagctgtgaascgcttgcccagacagctgcttcctgcaggcggtgcacacgaagcactcctttgtgccagggctgnctcccgcttaaagtattttcagaaatctgaggggaa

SEQ ID NO: 17217 - DNA, 432 bp, Homo sapiens
acttccggtgcgaacgcctcggccgttccctcgcggasttactgagcgcggccgccgagcccagctccgccgccgagcgcctgtgccggcacgkwacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtgtcgtgaaggcaaacaggattaaagtgaacatcacctttttatagcatt

SEQ ID NO: 17218 - DNA, 221 bp, Homo sapiens
agcagcagcgccgggtcccgtgcggaggtgctcctcgcagrttgtttctcgagcagcggcagttctcactacagcgccaggacgagtccggttcgtgttcgtccgcggagatctctctcatctcgctcggctgcgggaaatcgggctgaagcgacttgagtccgcgatggagagagaaaaggaacagttccgtaagctcttttaattgggtgggcttaagc

SEQ ID NO: 17219 - DNA, 400 bp, Homo sapiens
tcctctgtgctttgtgctccaggaaaaagcactgtgtattgtaagaaattagatgaattttcaaactcacatagcgtttgaaaaacgagatagaaatctcgttttaggctgggcgcggtggctcacgcctgtaattccagcagtttgggaggccgaggcgagtggatcctgggtggtcaggagttcaagatcagcctgaccaacatggtgaaacccatctctactaaaaatacaaaaattagccgaacatggcgcacgcttgtgatcccagctactcaggaggctgagtcaggagaaccgctggaacccgggcggtggaggttgcagtgagccaagattgtgccactgcactccagcctgggggacagagcaagactgcatcccaaaaaaaaaaaaaaaa

SEQ ID NO: 17220 - DNA, 535 bp, Homo sapiens
acaggaagtgggtaagggtaatatggaggagcttccggcaggccccggcggctgaaagccgcgsagaagtgctggtctcggtcgggattccgggcttggtcccaccgaggcggcgactgcggtaggagggaagaggttgttggacgcgctggcctcccgccgctgtgcattgcagcattatttcagttcaaaatgaactatatgcctggcaccgccagcsctcatcgaggacattgacaaaaagcacttggttctgcttcgagatggaaggacacttataggctttttaagaaggcattgatcaatttggacttggaaaagggagagtgacacacccctccaggcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtga

SEQ ID NO: 17221 - DNA, 565 bp, Homo sapiens
atttttggtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttcaagtgattctcctacctcagcctcctgagtagctgggattacaagcacctgccaccacacccggctaattttttgtatttttagtagagatggggtttcatcatgttggccaggctggtctcgaactcctgacctcaggcgatccacccacttcccaaagtgcagggattacaggtgtgagccaccacgcccagcctctcaacctatcaacctaatttttattcttagtagacacgttggtggtgagccaatcagatgttgttattgatgagaaaaagcagaaatgatttctgttgatcttgaataaattt

SEQ ID NO: 17222 - DNA, 571 bp, Homo sapiens
atttttggtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttcaagtgattctcctacctcagcctcctgagtagctgggattacaagcacctgccaccacacccggctaattttttgtatttttagtagagatggggtttcatcatgttggccaggctggtctcgaactcctgacctcaggcgatccacccacttcccaaagtgcagggattacaggtgtgagccaccacgcccrgcctctcaacctatcaacctaatttttattcttagtagacacgttggtggtgagccaatcagatgttgttattgatgagaaaaagcagaaatgatttctgttgattcttgaaataaaatttttt

SEQ ID NO: 17223 - DNA, 362 bp, Homo sapiens
gtatctcamtcccgscacagcttgggatcggtctctgctgttttacgtcctccacctcgggagcccccggtgactgtmacagcctcttgccctgtgatctgcaggttctgggagacgcacagctaagatgccaggacatcctggaagctgggaaaagatggggtttcgctcttgttgcccaggctggagtgcattatcccaatctcggcttactacaacctccgcctcccaggttctgacaacaaaggagattgtgacatattgctgggcctaacactaaggtgatgttagttatttgctttggctgtgccttggaaggcattgagacatactgctgtgcccagcaccaagatgatgtgagt

SEQ ID NO: 17224 - DNA, 479 bp, Homo sapiens
ttaattattttcattttgtcaaggtttatacatttacattctgtacatttacattctgttctgtagctataacagcctaactatgattttttaaaataggattatttatttaataggtttttttttaatagggttatagtgggttaacagccctctgttgcccaggttggagtacagtggcgcaatcatagctcactgtatgtaaccttgaacgcctgctcaaactatcctcccggctcagcttcccaagtagcttgggactacagatacacactaacacctggctaatctttaaattttttgtagagacagagtcttgctatgttgctcaggctgatctcaaactcctggccccaagcaatcccctgcttcggcctcctaaagtgctgggagtacagatgtgagttacagcacccaatcctataaagtttatataaattgttttcccaactccagtactcattaacataaaaaagctt

SEQ ID NO: 17225 - DNA, 285 bp, Homo sapiens
agaggacgatgttccctagtctaatctgctctttccttccttcattcattcaatcaatcattcacgcagctggccagcagacactggatgaccacccctgggccaggccttgtggcaaatgctacagtaatgaccagacacatcacacccgccttctagaagccctccctcacaaaccggatcaactgctatgataaagtgtccactaccattccttgagggcttacaatggcttctggttgggagaaagatkggaagaggaggacattcaagaagatcagagac

SEQ ID NO: 17226 - DNA, 462 bp, Homo sapiens
attgaaggaagcccagtcctctgggttttagagatttaggccccctcccgccttttgatccccaaattttattgtgttgggcggttctaggggacgtgagataaagatttagcaacaagtcccagcgatttggggcttggaagtggccaggaagaatcggcgacttaggaaaaacgccaacaatacggattctaattccaaaggaatcatttggttaaaggtcaccttcatgtaaggtctggaggaatggcggagaatctaggggactgttttacattttccttgtggaagatagggtatagcataccctgaagaattacatgcaagatgagaagaaatcatttatatggaaactagaatagctgatattccagactaagagccaaaaaaatgtgtgtcagagtcagctagcaaacaccaggaatcggctgtgaaggaagattgaaatttaaattcatatta

SEQ ID NO: 17227 - DNA, 126 bp, Homo sapiens
catttgtccccaactccccatctggccctgctgttgctagtacctgttatttattacctggaggcctgtccagcacccaccctacccccataaagcattgtttacacctgaaaaaaaaaaaaaaaa

SEQ ID NO: 17228 - DNA, 377 bp, Homo sapiens
  misc_feature 305,309: n=a, g, c or t
gtcaagcgtgcggcggcccgtggaagggaactccctccactagaatatgagctccttgtggtcaagactgggtcccctgttcccttccccccagtgccagckgasaaagagtctccctctgttgcccaggctggagtgtggtggcgtgatcttggctcactcaacctccacctcccaggttcaagcgattctcctgcaacctctgcctcccaggttcaagcgattctcctgscttggcctcctgagtagctgggattataagcgtgtaccaccaaccctggatgatttttgkatttttagtagangcanggtttcaccatgtttgtcargctggtctcgaactcctgacctcgtgatcctcctgcctsggctcccaa

SEQ ID NO: 17229 - DNA, 382 bp, Homo sapiens
caggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccgagtgtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaaaaaaaaaaaaaaaaa

SEQ ID NO: 17230 - DNA, 453 bp, Homo sapiens
atattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaat

SEQ ID NO: 17231 - DNA, 248 bp, Homo sapiens
acctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaaaaaaaaaaaaaaaaag

SEQ ID NO: 17232 - DNA, 391 bp, Homo sapiens
agaatcagttccgtctccaactcactagtactcagccgccgcaatcagggggacaggtagctcgagcgcgcgctccacctgctccgacgcgatgcgggccaagtggaagaagaagaggatgcgtaggctcaagaggaagcgccggaaaatgaggcagagatctaagtaggcgcatcttgggaccgaggatggcgagcttctcctgcaccatggctgagccgcgttgggatgatggtctcccttttttagacgtgctttgctgtagacgtaggcgattgtaaaccgtcctttttgattaattctagcatgttctgagactgggtttatattgtaatttgaggataattatatgatgctctaagttaaattagattcctggcaaaaaaaaaaa

SEQ ID NO: 17233 - DNA, 387 bp, Homo sapiens
agaatcaggtccgtctccaactcactagtactcagccgccgcaatcaggggggcaggtagctcgagcgcgcgctccacctgcgccgacgcgatgcgggccaagtggaagaagaagaggatgcggaggctcaagaggaagcgccggaaaatgaggcagagatctaagtaggcgcatcttgtgaccgaggatggcgagcttctcctgcaccatggctgtgacgcgttgggatgattgtctccctttgtagacgtgctttgctgtagacgtaggcgatgtaaaccgtcctttttgattaattctagtatgttctgagactgggtttatattgtaatttgaggataattatatgatgctctaagtttattgatattcctgtcactcgagaa

SEQ ID NO: 17234 - DNA, 407 bp, Homo sapiens
tttttccctaagcccctcccttttctttcagcctttttccttcccccattatgtcatgacctcacttaagtggaacactattatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggaaaaaaaacaaaaaaacca

SEQ ID NO: 17235 - DNA, 422 bp, Homo sapiens
tttttccctaagcccctcccttttctttcagcctttttccttcccccattatgtcatgacctcacttaagtggaacactatatcataacccagagattcgtcccagccccagagtccgacagactgtctggtccctattcctaatgagggggtgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtrtatgttattaaagatacaaaatgttgggaaaaaaaacaaaaaaaccaaaaaaaaaaaaaaaa

SEQ ID NO: 17236 - DNA, 286 bp, Homo sapiens
  misc_feature 117: n=a, g, c or t
tgctaggcggcctgcccagctgcagcccccggactctgatctctgtagtrrmmccctcctccccggccccttttcgccccctcttcaactcctctcactttttaaagcattgatatnaktatcttctcagatacagaccattttatgattttttaaaaagtaaaagttctaaaatgaagtcacacaagacaattattcttatgcctaagttaacagtggataaaagacttttctgtaaacaactccagtaataaatatcatgaactaaaaaaaaaaaaaaaaaaaa

SEQ ID NO: 17237 - DNA, 463 bp, Homo sapiens
actagctgagacccgcagcagccgcagagcacgctcagggctaaagtagccgcacccgctgtctaggaaacggttacctgagcggttgtcaggacacaacgacccagacgccagagccaacgccaaacgggtagaggcctatcgagcgcccttaaccacsggcatttgactcgcagcccgcggcgagacttcggcctggagcccccgcgcggagacgccgacgccgaacacatttattcttatttcgaatgagccattttttccccactggaaaacctcccttcaattagaaagatgaatttcaaaggttctgaagagtgggttagcaactttcgtcagagtcatcttggaaaggtgaaattgatggttccataggggaaaaaaaattggtttcccaatctgcttctgaaaaggaattcttctggctgaataggttggtagcttgagtcgagtaaccttcctt

SEQ ID NO: 17238 - DNA, 415 bp, Homo sapiens
gttgttagccaagatggcggtasgatcgctgcagcgagggtctggcggctaaaccgtggtttgagccaggctgccctcctgctgctgcggcasctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaagagaaggtgctgaagctctacaagagcatgacactgcttaacaccatggaccgcatcctctatgagtctcagcggcagggcggatctccttctacatgaccaactatg

SEQ ID NO: 17239 - DNA, 276 bp, Homo sapiens
taaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaact

SEQ ID NO: 17240 - DNA, 324 bp, Homo sapiens
  misc_feature 154,239: n=a, g, c or t
gaaacgcaccgtgaagaccctctaactgtgcctactattctgctcccctccgatcggcgcggggctcttgtccttcctctctccacccagcgaatgaatgaacgcaggagcgctcggagtacacgtcttcaactcggcgacgccctgcttcggnccaccccgcaaacamccgscccggaccaggcccarggtaggcgcccatgaggacccgtmcstgctcctgamcatcaccgtcactngggtsactgtgctcgtgttggtcctgaagagcatgaactccaggaggagagagsmaatcassttasaggaccctgaagccaagta

SEQ ID NO: 17241 - DNA, 523 bp, Homo sapiens
taccaataatatttagagctagtctccaagcgacgaaaaaaatgttttaatatttgcaagcaacttttgtaaagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtatatttctgtaatttatggtgatatttaagg

SEQ ID NO: 17242 - DNA, 329 bp, Homo sapiens
agcacgtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggagccccggggaagagcggggtgccggtgtccgctccgggctcggatgggaartggtgggaggagcgacccgggatgttcagtctgatggccagttgctgcggstggttcaakcggtggc

SEQ ID NO: 17243 - DNA, 510 bp, Homo sapiens
aagggaataaaattggccacctcagccagcagcagcaaccagctcgggtctctttctaccctgggatctttgttcttttgctgttcactataaactttactactactcactctttgggtctgtgccatctttaagagctgtaacactcactgcaaaggttcgtgagaggccatgaacccacctggtaggaaccaactccggacacagtacctactagatagctcattttgcattattctgaagtgagaagaacattgctgtggacctcgttcttaagtgtattctcaagattaacacctccacactggaatgtgaaattaatcaaagcagccaggccagcacgttgggtgtcactgatgttttccaggttgtttttccttcttaacctgaaaaaaattagaaagcttctttgccctccaaattgtaggcaacagaaaaggttagaatacattggaaaacttagtttttaaaaaattccacttttagactgcacctgtagtccaagctact

SEQ ID NO: 17244 - DNA, 468 bp, Homo sapiens
ttctatactactatgttaaacctactactttaatgatctggctaccgtctgccaaatgtcacttttcaagtgagaacagaagaatgagattgtgaagattctgtggacaatgtctatataatcatttaagtgttaaatataaactaaatgacaatagcagcttgtaaattaatgctaattctggctgggagcagtggctcaggtggctcatgcctgtaatcccagcactttgagaggccgaggcaggtgaatcagctgaggtcaggagttcgagaccagcctggctaacatgatgaaacctctctactaaaaatacaaaaaattagccgggagtggtggcacatgcctgtagtctcagctactctggaggctgaggcgggagaaccgcttgaacctgggagatgggttgcactgagctgatatcgtgccactgtactccagcctgggagacagactccgtcccaaaaa

SEQ ID NO: 17245 - DNA, 424 bp, Homo sapiens
gtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagactcggacagcggctccgggttctggaaggccctgaccttcatggccgtcggaggaggactcgcagtcgccgggctgcccgcgctgggcttcamcggcgccggcatcgcggccaactcggtggctgcctcgctgatgagctggtctgcgatcctgaatggrggcrgcgtgcccgccggggggctagtggcacgctgcagagcctcggggctggtggcagcagcgtcgtcata

SEQ ID NO: 17246 - DNA, 318 bp, Homo sapiens
actttwmcgggaggscttcacrtrttccagcamrrgawaccactttgcagtgccagactggmwgaagtaacggtcamtctgaaamcagggtgggagagctgcctctctttgaacctctcccaggcccaactctaacccagggaggcamacttggtcgatgtaagcggtggcttggagacagaatcatctavtggarmaggatacactagaaggtgctggggatacatcagaggtgaawvaatactcaggcgggctccgtggatgwmgagaatggccgacagttgggtgaggtagagctgcaatgtgggatttgtacaa

SEQ ID NO: 17247 - DNA, 311 bp, Homo sapiens
atttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcactccagcctgggcaacagagtgagactccgtctcaaaaaaaaaaaaaaaaa

SEQ ID NO: 17248 - DNA, 384 bp, Homo sapiens
ctttcgcatttcgggacggctggaggctggcaccgtggcccctgcgccccacgtggcgccctttccgggcggggggggtggggaggcacctccagcgacaactctcccccctcccccggcwcccggctgatttgctgtgccactgggagggttcgggggtggctgagctgagagggctccgggaaggagtgacgtcaggacctgccttcagccccctttgtgccgcgggacgcccagcggcacgacgtggagctcctggagagcagctdccctgccattttgcgggacttcggggctgtgagctgggacttctcagggactacccctccgcctcggggctggtccccacctctggcccccgggtgctascagctcctgctgtac

SEQ ID NO: 17249 - DNA, 457 bp, Homo sapiens
aattgtgaaatcagaaaaaaattcagacttccaattgaggtactaaacaatgtatttctgaaattatctggattgaaaacaaatctaagagcacacatcttgatacgtgcaatcacgttcaacagawactcgcccacgttaggatgtaatcagaatcctgawtagacctgmactcgcaacagactggaacgggaatagagcaccgagggctgtaccaggggcagggcagaagacagccamccgcccaggscgaatcactcactgggasccggctcaggtaatcctgargcgtcctcgggggtacgaaggatcgaaamcttycgtcaagtcgsaaggstctaacggcaatagscgaggcatcaactcttccamtgcggactccgctggtamccamgscatggttttcaaaccagccagttccgctcggcgcatgcgccmattctaggtcamagcgcag

SEQ ID NO: 17250 - DNA, 291 bp, Homo sapiens
caatgtgtttgcaaccttaagtaaggaaagggaaaaaaaaaatagccctctgaactctgatcttttgccgcttctgtagattttgattgtgaagttgggagtgaggacattcaaaagcccatggkgaatgcatatgcctttagaatatkgkgcctgttttaaaatgtttgagcttttaaaatactttgttaaaacatgaatccatttttgtaattgtataaatactcataactaattttgaatgctactgattgtgtaactgaatttttgtatccaaaaatacattcttga

SEQ ID NO: 17251 - DNA, 274 bp, Homo sapiens
aactctgtttgggtctcagccctttggatgttaatcgactgggtccgtgcacctaaataattaaataattcctcctcaatcccacggtctctctgattccttaattatcccactgcacactctgtcacccaggctggtgtgcagtggcgtgatctcagctcactgcagcctcaacctccagggctcaagggatccttctacctcagcctcctgaatagctggactgcagatatgcatcactacacccagatgttgaagtgctgttttttaaagc

SEQ ID NO: 17252 - DNA, 443 bp, Homo sapiens
  misc_feature 207,266,312,314,350: n=a, g, c or t
attttgtcttgtcggctcctgtgtgtaggagggatttcggcctgagagcgggccgaggagattggcgacggtgtcscgtgttttcgttggcgggtgcctgggctggtgggaacagccgcccgaagaagcaccatgatttcggccgcgcagttgttggatgagtttaatgggccgggaccgaaacctagccccggacgagaagcgcanaacgtgcggtgggaccacgagagcgttttgtaaatattatctctgtggtttttgtcctncggaattgttcacaaatacacgttctgatcttgatgtatttggaanangagataacattagagatgtcagcaaatttttggaanatgacaagtggatggaggagtagcagcaaacgcaacagagcagagcaacctgtaccctaaaagcctgcagaaggggatactaaacagaagcga

SEQ ID NO: 17253 - DNA, 560 bp, Homo sapiens
tatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcggggagg

SEQ ID NO: 17254 - DNA, 433 bp, Homo sapiens
ttttgccctccttccccccttcgtccgctctcattggctctgctgagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtgggctgatcccagtctttttttcaaatgttttctagtagcatcttgagctcttttcttgaattattaaaaataactatcattaattaaaaa

SEQ ID NO: 17255 - DNA, 335 bp, Homo sapiens
cctagacccacagcccctcgggagcaccccacctctgtgtgtgatgtagctttctctccctcagcctgcaaggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactattaaaaaaaaaaaaaaaaagg

SEQ ID NO: 17256 - DNA, 722 bp, Homo sapiens
aattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccacatttttgtgtgtggaaagacagttttctatccacgtctttttctgtttgtcagaaggtgggagtatggtccaaataaatccattaggttactcctgcagcatgcgcttttagcttctctcttgactgaggatcaaatatcctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattc

SEQ ID NO: 17257 - DNA, 447 bp, Homo sapiens
  misc_feature 371,395,397,407,410: n=a, g, c or t
aatattgcgcctgcgccacgccggctgcgagactggggccgtggctgctggtcccgggtgatgctaggcggctccctgggctccaggctgttgcggggtgtaggtgggagtcacggacggttcggggcccgaggtgtccgcgaaggtggcgcacatgggcggcaggggagagcatggctcagcggatggtctgggtggacctggakatgacaggattggacattgagaaggaccagattattgagatggcctgtctgataactgactctgatctcaacattttggctgaagaaattcagttcatgaagataagaagtttcttgacaaatacatgccccatttcatgaaacatctkcattatagaataattnatgtgagccactgttaaagaactntncagggcmttnatnacattagtgaagcatcaragagcttcagtttttaccg

SEQ ID NO: 17258 - DNA, 479 bp, Homo sapiens
agactattgcgcctgcgccasgccggctgcgagactggggccgtggctgctggtcccgggtgatgctaggcggctccctgggctccaggctgttgcggggtgtaggtgggagtcacggacggttcggggcccgaggtgtccgcgaaggtggcgcacatgggcggcaggggagagcatggctcagcggatggtctgggtggacctggagatgacaggattggacattgagaaggaccagattattgagatggcctgtctgataactgactctgatctcaacattttggctgaagggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccaggggctctgtccact

SEQ ID NO: 17259 - DNA, 351 bp, Homo sapiens
tgtttttagtctcttgtgctgtgcctagtggcactgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtacttttttttttttctaactgctaaaaccattctcttccacctggttttactgtaacatttggaaaaggaataaatgtcgtcccttcaaaaaaaaaaaaaaaaag

SEQ ID NO: 17260 - DNA, 480 bp, Homo sapiens
ggtgtggcctcgctcctccaggaagcttgtcctccactctgaaacctccagggcgctttctgtcttgtgcatttcagcagctgaaccgctgagtatctgctattctttttgatcttttggcatgcgagatattaactaagggatggctgggcctcactttaagcagctgcaaagaagaatgatgattttctaacaagagctttttttctgtccaccttgaatgctctatctctggacttgtaagacaatccttcctgctgattgcgagtaaargtaacctgatgaatcttcttggtgtgaaacttgtccatattacggattgtgtccttaggaaagaccccagaaaggaatggcaaggcccccaggtgatgtcgacaccgctggcctgaggacctcacttgagtagagaagtgtgaggggacttaggcaagcacatgcatcctcagtgacagagctggaacccatgtctgcccaacgcca

SEQ ID NO: 17261 - DNA, 69 bp, Homo sapiens
agagcagcgggcgcgctcataaagggcacagccgagggtacgtggatcgcggtgcggagactgaggtta

SEQ ID NO: 17262 - DNA, 536 bp, Homo sapiens
agattcaatcttttaagtctgttgattgtatatactggaatatatgtttagtgggttacaaacccaatttatctttttcaatttaattttgttttatatgttgggtatggctctgactaccactcctaagaaaaacatcttaggtccttaatgaaggccatggtttccctttgtcctcctaggattctgcaaatttttttattgagccatctkgaaggggacatkgagacagcctaaagaaagaaataagttatgaatgaaaaaagcaagtgatagaagaatacatatggtatgattcacagaagaatacttgcaatgtgatccatttataaaatgttctaaaagagacaaaccaacaatatattgtctagggatacagtcaaaggacagggaatgattacaacaaaaatcaaggtactagttacctggggatggttaaggagagggatgtaacctcagaagggtacacaaaatgtatttctgatattactggtggtgtatttcttaacctgaatcataaatatgtacacaacgaa

SEQ ID NO: 17263 - DNA, 466 bp, Homo sapiens
agtttacaagtctgttgccctaggtgatagattcaatcttttaagtctgttgattgtatatactggaatatatgtttagtgggttacaaacccaatttatctttttcaatttaattttgttttatatgttgggtatggctctgactaccactcctaagaaaaacatcttaggtccttaatgaaggccatggtttccctttgtcctcctaggattctgcaaatttttttattgagccatctggaaggggacatggagacagatgagcccagccctaacagctattcaaggtgtcagacatgtaagtgagtgatcatgagtgttccagcctaatcaagctcctagataagtccatctaacatccaacatcaagtggagcagaagaactgcccaacaagcaagtcaaccccacagtatcttgagagataataaaacatcttttttaatccacaaaaaaaaaaaaaaatg

SEQ ID NO: 17264 - DNA, 454 bp, Homo sapiens
agggtctcacgtggccagccccctccgagaggggagaccagcgggccatgacaagctccaggctttggttttcgctgctgctggcggcasgttcgcaggacgggcgacggccctctggccctggcctcagaacttccaaacctccgaccagcgctacgtcctttacccgaacaactttcaattccagtacgatgtcagctcggccgcgcagccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaccagcttcctactttggagtcagtggagaaattataccctgaccataaatggatgaccagtgtttactcctctctgagactgtctggggagctctc

SEQ ID NO: 17265 - DNA, 489 bp, Homo sapiens
taaacctcctatttgctggtcttagtgtctgtatctgtcttttaatgttataaactcttaaatgtagatttagattcttgttttggggttctttgtttgtttaagtatttggtttaaaatacaaatagaggcctggcttggtggctcacgcctgtaatcccagcactttgggaggctgaggcaggtggatcatgaggtcaggagttcgagaccagcctggccaacatggtgaaactctgtctctactaaaaatacaaaaataagccaggcatggtggttggcacctgtaatcccagctatccaggaagctgaggcaggagaatcacttgaacccgaagcagaggttgcagtgagccgagattgcgccactgcactccagcctgggcaacaagagcaaaattccatctcaaaaaaataaataaataaaatacaaatagaaattcaggccaggcacggcagctccttgggagactgaggcaggtggatcac

SEQ ID NO: 17266 - DNA, 472 bp, Homo sapiens
ttgatgttgcttacattgttctcctttgctggggtgggggctggaggggcgggagagagtgccatgtgtagaaagagcactgggcggggagtcaggagacgggcattggagggatggcactaactgcgagaagaaggcaggccccagtgtttcatctgtaaaaagggaagactgggctgggcttggtggctcacacctataatcccagcactttgggaggtcaaggcaggtgggtcacctgacctcaggagtttgagaccagcctggccaacatggcgaaactctgcccctactgaaaatggaaaaattagccaggcatggtggcaggtgcctgtagtcccagctacttggggggctggtgcgggagagtcgcttgaaccagggaggcagagattgcagtgagccgagattgcactactgcactccagcctgggcaacagagtgagactctgtctcaaaaaaaaaaaaaaaa

SEQ ID NO: 17267 - DNA, 544 bp, Homo sapiens
aaaaagcagaggccagttatatttttcaaagatgctacagcagttatctcccatccaacaagctctttggtgatgggaacttgccaacccagagtctaactttcctccccttaagtatggattggacttgatgacttgcttgaccagtaaaatgtggcagaggtgatggtctgggacttttaaagctaggtcagaagcagcctcacagctttttacctggatctctagggactctagctgttagaaagctcactctgggaacctagtcgctgtgttgttaagatgcatggagaggccatgtatgggtacttcaattgacagcccaaggtgagcttccagctgacagccagcaccaactgccagccagcaccaactgccagccatgtgagtgggccattttggcatcaagcagtagtagaggctttggatgactgcagctcctgccaacatctgactgcaacctcctgagccaccccaagtgagaactatccagttgggcctggccaacctgcaggactgtaagagctaataaaacattactgtc

SEQ ID NO: 17268 - DNA, 555 bp, Homo sapiens
  misc_feature 24: n=a, g, c or t
gttggcggasagagcggaggcgcncgkggcggagggcccacgagggctcagccttcccggtcagcggtggtgacggtatcccaggagtgccagagaaccgttgcttttccgagttgctcttcktbcaaggytcgtttgggtggtcggcatggcccgtggaaatcaacgagaacttggcccgccagaaaaacatgaagaaaascccaggaaattagcaagggaaagaggaaagaggattarsytgrmtggctytcagagaaaagcagagggactctgagatcatgcaaagaaaagcagaaggcagctaatgagaaggaagtctatgcagacaagagaaaagtgatgactggctatttggaaaacctgggtgctactgccaactggggtgtatcataagctctaagatcaagatttttgtagagtgggacagtcattacatatggttataacttatcctttaaaaactattttaaacttttatccttttcagctttactttagtgcgatgtttttagaagcagtcttcaagataaacctaccatgctgcgaaaaaaa

SEQ ID NO: 17269 - DNA, 586 bp, Homo sapiens
  misc_feature 24: n=a, g, c or t
gttggcggasagagcggaggcgcncgkggcggagggcccacgagggctcagccttcccggtcagcggtggtgacggtatcccaggagtgccagagaaccgttgcttttccgagttgctcttcktbcaaggytcgtttgggtggtcggcatggcccgtggaaatcaacgagaacttggcccgccagaaaaacatgaagaaaascccaggaaawttagcaagggaaagaggaaagaggattarsytgrmtggctytcagagaaaagcagaggggactctgagkatcatgcaagaaaagcagaaggcaggctaatgagaaggaagtctatgcagacaaaaggaagaaaagtgawgrctkggcyaatttggaaaaacctgggtgctactgccaactgggtcgtatcataagctctaagatcaagattttgtagagtgggacagtcattacatatggttataacttatcctttaaaaaactattttaaacttttatccttttcagctttactttagtgcgatgtttttagaagcagtctttcaaagaataawacsactaaccatgcatgcgaaaaaaaaaaaaaaatgcga

SEQ ID NO: 17270 - DNA, 464 bp, Homo sapiens
acgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagaggtacgtggtactaatttaattctaaagtcactgacgttgtgattgaagcaacattttgggctgggtgtgttgcctcatgcctgtaatcccggcagtttgggagagtcgggagaactgcttgaagccaagagtttgagaccaacttggacaacatrgccagcccctgtatctacaaaatatttttttaaattggccaggcatggtagcacatggctgtggtctcggctactctggaggctgag

SEQ ID NO: 17271 - DNA, 294 bp, Homo sapiens
acgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagaggggactctgagkatcatgcaagaraagcagaaggcaggctaatgagaagaagtctatgcagacaaggagaaw

SEQ ID NO: 17272 - DNA, 366 bp, Homo sapiens
  misc_feature 132,212,227: n=a, g, c or t
aaaaatgcgaacttaggctgttacacaactgctggggtctgttctcgccgcccgcccggcagtcaggcagcgtcgccgccgtggtagcagcctcagccgtttctggagtctcgggcccacagtcaccgscgnttacctgcgcctcctcgagcctscggagtcccagtccgcccgcacaggccggttcgccgtctgsgtctyccccacgccgnctygcctgscggcgngctcgtccctycgggccgacatgagtggggaccacctycaccacaaattaaagatgaacctgaagatgatggctattttgttcctsctaaagaggatataaagccattaaagagacctcgagatgaggatgatgctgat

SEQ ID NO: 17273 - DNA, 199 bp, Homo sapiens
  misc_feature 136,139..140: n=a, g, c or t
tgcgaacttaggctgttacacaactgctggggtctgttctcgccgcccgcccggcagtcaggcagcgtcgccgccgtggtagcagcctcagcsgtttctggagtctcgggcccacagtcaccgccgcttasctgcncsnnctcgagcctccggagtccccgtccgcccgcacaggccggttcgccgtctgcgtaaccac

SEQ ID NO: 17274 - DNA, 321 bp, Homo sapiens
aaaaagcagattcatcagtttaaaaatacagtttgaaaacaccagcctagatgatctttgaatctccttgctctgaactcagtgatttcaggcaaaccagggatgaactgctcaaggccaccaactaggccttggctcttcttgatcatgaatcaggcctcttccatttgttaacaacaatgtctggtagaaagaactgatgttcccccaagcctgaaaagcagagtctttaaggaagaaattttcaaaattatctgagagggcaaagtggcaaattggttctgttttttacctctcaataagcaagcgataaaactgcaa

SEQ ID NO: 17275 - DNA, 473 bp, Homo sapiens
acaggtgaacttaagaatggagaatgaaggggggaggaggcacaagggactggctactccttatgggttctctttagttcttagaggtctttggatgtcaccaagctgagaacagctggaaggggaatttgaacatcttccaaacctctctattacttgaagttgagaagaaagtgattctgtctcacagtagcatatcaattcagtttaaactgcatttatactcaagtgtagtaattactagcccaatatttagtaattgtagattttaaaattctggccaaaactaaataatttaaaagttgaattgtttagcgcgagtgtggtggctcatgcctgtaatcccagcactttgggaggccaaggtgggcagatcgcttgaggtcaggagttgcagaccagcctggccaacatggtgaaacccatctctatcaaaatacaaaaattggccgagtatggtggtgcctgcctgt

SEQ ID NO: 17276 - DNA, 222 bp, Homo sapiens
aatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaasaggg

SEQ ID NO: 17277 - DNA, 191 bp, Homo sapiens
tcctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaasggcggarcarggcagckkcctgaagatgatgggctggags

SEQ ID NO: 17278 - DNA, 486 bp, Homo sapiens
acatcaaggagccaatctgggaaacactatcagaagaaaaagaagaaagcaagtcttaaagcctcagggaggccatttttgcctgaatttgaaatgagggtgggccagatgagtatgtttaagtggagagtgcttccagctgagatgatttgagtctgccctaactgctctattgagttctcgtgccctcatcagctgagagcagggaatggaactttaatgcaagaaccacttttatctactcttttttgtacatgtcattgtttcagttctgatttcaacaaacatgagcaaaccactttgactcaaagcggaaagagtgaaaattctattttgttatgctactggtgttcaattattagtttgtaccatttttaatttatgtcagttgatgcatctgaaaataagtgcttgaagtgttcacacccttactttttttttttaarattcctagaaggaatctttggttaattcagattgagcagt

SEQ ID NO: 17279 - DNA, 421 bp, Homo sapiens
actttttcgcctccagggacactgacgcatgcgcatcgtgccctggaccaggcggccgtggcgcgggtggcggctgctgtgctggctgtggggacggaggcggtgaagtgccatcttcggctaggtcgtcacaggctccggctcatggcatcaagtggcatccatcataasatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttc

SEQ ID NO: 17280 - DNA, 524 bp, Homo sapiens
agtgctgggtcgggcttccagctccctacaacgcagaccagtactggagttcgtggtgctggaagaccgccgcccgactctgggccccgggtaggaaacaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctkaggtaggcgctggttgaaactgaagttggagagagcaagtggcatttgctgaagtgcatttccggtagaaaactccagtggtccctcacctgactgagtgkcgcagtcagagataaatggaacagagtctacaaataaacattttataaagatgatccttcaatacatattctacagcccagttaaaatgtgagaggccatgatctacagacagccatttataaaggtggatca

SEQ ID NO: 17281 - DNA, 448 bp, Homo sapiens
taatcatagtcttaaatgttagaaatcctatataatattatttattaaaaattgcagatttttaatttaaaatacatttttatttttaaattttgtcttttccctttttttttcagatcaacaacccctccccgtcgtaaacgctgaggaatgatgtggcaagaatgccatgatgttctttaaaaaaattccatkagttttaagggcttgtctcattatagaggcacattgtggctgtgtaggtgaaacagaatcttttttttttttwaatctgtaaataggkgtactttttccaatgctgctccaagttacttaataggatttctttgtattacgtttttttcaaaaaatatagtgcataataagctataaacatgccattctctttcagctgtaatgttcttaaaattattcttgaatgtactgtgatgtcaataaggctctttag

SEQ ID NO: 17282 - DNA, 486 bp, Homo sapiens
aaaaacgaggctgaaaggaaaatgttggggagcttggtggagtctgggtttagggctagcccaggagggaacgagcctgaacttcaggggtgagtttctttcagggacatcgagcgaggcaggtgttccaccccactttcttatttgaggggagaaggaaaccaaagccagtagaaatggaatttatggcctccgtgctctcagagggagaaaaaaattctcactcatcagcctaaagagaaaccctgtcttatcccagattaccaccatgggatttaaaattcagtgagaagactgcttgggaaatactgtctccgaactgccggtacagacactgcccattggtacaatatttttaggtcatctgtcaattgcatgtttgcatttctttcatgcaatacaagttgaaatcataatgaatttcttgagtttcaggaatatctcaaaataaacttcttcatcctcaacaaatgaaaaaaaaaaaaa

SEQ ID NO: 17283 - DNA, 468 bp, Homo sapiens
tctctgttttagagtttggggctagtgtgtttgtgtttccattctaagattgagtctggcagtccctgtttttttgcattggggtaactgctctttgattttttttaattgcagtatttgtgtgattgcaataataaagtttggtttggkttttacagtcatgcgcagggacgatccttsttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctacbaaaggaattttgatcatggcataagtgt

SEQ ID NO: 17284 - DNA, 499 bp, Homo sapiens
atataaaattctctcatgctaacaactggcatactatcaatttctcctgaagagcataggtatagtactctgcactgaactgatgagtgatctctggtatcgttgagaatcccacattctcctcttacctagtacttggtttcttcctctagaagatggcacactagtactatcaatgatatccattttgaggactttttttcaaaagaagactacgttgtcttcaaaacaaagaaaagaaccatatagatatcaagccatctttactaactctatctttttaaataatctcattcagaaacttcttctgacaacataagtcaagtcaggaaccatcagaacctacaactcagaaagataaccaggtcgccaatcatttactcaactattccaccatccagtattgtatggttgaatcagaaatcgtgctaaaacatgtttttaacctggcacttcaaagtattcacattttcaacaatatgctttcagcaaatgaatt

SEQ ID NO: 17285 - DNA, 512 bp, Homo sapiens
  misc_feature 355,395,398,400,402,405,449: n=a, g, c or t
acctccttgattctcagttttgctggaggccgcaaccaggcccgcgccgccaccatggtacgttgaatcccgatctctggaaggkttargggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcgntccagaatagctcctagtgctgtgtatggkagakkawcdnahnhnmnaandgacwtggaggcctacctgtaccaccagtgcggacttgaccccnaggtttgtgttcctggamagcgtcgttttcctgkttcgaatcatatgacaatgatgtcactgt

SEQ ID NO: 17286 - DNA, 53 bp, Homo sapiens
astttcggcagcacctccttgattctcagttttgctggaggctgsaaccacca

SEQ ID NO: 17287 - DNA, 369 bp, Homo sapiens
  misc_feature 210: n=a, g, c or t
agagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcascctgctccatcggcttcgcgggtgcaagggcgctgggggaagaggggaaccggngaggatggcgggatgtggagggggcaggcgccggagaagaaagaaggggcacgattggccaagcccgtgcaccgttttttgtaaggtacaataagaacatgtcagaagttcctaattcagtacaacaggagacagctgttgatcttgttgcagaactgc

SEQ ID NO: 17288 - DNA, 510 bp, Homo sapiens
taaggtgataagaagtttgtatgcttttttatctgtgaaccacctggagatcgactggccactgggtcttgcattttaatagaggggaatagtagtgtggagaatataaaatagtaaataacaacaacacaaaattctctgacttcttagtgctttaaatggtttagaggaaattcactgtggctgggacgctgaggcctcccaccatgtgtggcctaaacttgacattttataaaggcaaactgcacagaggagagtaacaaataaccacacttaataaggaggcagtaactttcagctcttcgtgattctagccaagtccaaggccacagtgactggaaagacagcttgcagccagcctgacaagggagtcaagacaacaccctcctcctctgcaggtttctgtgttcgaatgtccctccctcaccgccttctggagagagaccttgtttctttgggatggttttggatgcagccttgcatcacctgagaagacacctggcctggagc

SEQ ID NO: 17289 - DNA, 501 bp, Homo sapiens
ttttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtga

SEQ ID NO: 17290 - DNA, 559 bp, Homo sapiens
caagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaagaggggacagggagcttcctaggtctgttgataaactaactgatgctttgtcaaatcttccaagttttcactgtaaataatacaactaacaatgtaattttgctgttttctaatagagaatgaatgaatatattaatgtattacatttgtttcatgataaaacagtttt

SEQ ID NO: 17291 - DNA, 450 bp, Homo sapiens
aaattcatcactagtgttttgaaatcccaggatgtgttcctgagacagtcttcgttgttttattgtcctgggcattctgcgtcctttcagtctggagatttttagcttcctttgcttctgagtctctatttgcagtgccccgatgctagaaacctgagatcccatggcttctccagaatggaggcttgggcattgtcagcaccctccttccaagagttgaaagttcctctcttctgacttgtggaagaaagcaaactgatcccactcatttttgaagtaactctggaacatcaggagagcattctgggtaataccatgcaaagtgtgattgcattactcagcaatctagttgcctgcaaagattcgaatatgtaactactttatgaacaaggacttgtcagtcacatctgtaacctgctcactgaaactgccacactgtgcttggatgtg

SEQ ID NO: 17292 - DNA, 415 bp, Homo sapiens
aacaacactgccagtgcttgcaaacttagaggatttaaattcatcactagtgttttgaaatcccaggatgtgttcctgagacagtcttcgttgttttattgtcctgggcattctgcgtcctttcagtctggagatttttagcttcctttgcttctgagtctctatttgcagtgccccgatgctagaaacctgagatcccatggcttctccagaatggaggcttgggcattgtcagcaccctccttccaagagttgaaagttcctctcttctggaagacaaactgatgtgaggatgaggaggagtcagaaataaactcattcaactaatacttgagtagctactgttgcctacagtatgttcaaggttttgctagtcatccatatgatcactattgacagcttgggagactcacac

SEQ ID NO: 17293 - DNA, 471 bp, Homo sapiens
attcttataggcagttaaattaattgcagttcagtttcttcttttcaagcctttgttagggtaagtatagagtgagcttcaccccacagagagtttaacaccatttctaaggcatagctattgtgggatcactagaaaattctgtgagtgatcagctgggacactcaacactggctagttggacctcagatgcctcacaggcctgtgtggcactctgcttgacctcgtagagttttgctctaggcttacatgtcttaatatccagccacctctcaaggggctcctatgcagatttctggaattctgtttttacatatctgttagctctctggtactctgctctgcaacttcagccacttcagcctccctgaactccagcctctgtcttctcaactacatgaaaccaccatgctttgtttgggatcccctaccctgctctgaggtctgtgcctgcaggtagaaatctagaat

SEQ ID NO: 17294 - DNA, 403 bp, Homo sapiens
attttcctttttgtttttgttgttgatgtgaccgcgtgtccacaaccctgggattccctcgccctcagattccagaatccaatttcttggatttcagtgtttttaaggtcagtggaaacttttttaaaaagcaacattaagctaatatattcttactgcagaaaaggagctttgttctatttatctctaaaactgatgctcactagtagttctcagatttggaaaggtatttgtactatttatttataggagcatttatttataggaaatactggctgggcgtggtggctcgtgcctgtaatcccagcactttgggaggccaatgtgggcggatcagtttgagaccagcctggccagcatggcggaaccccgtctctactagaaatacagaaattggctgggc

SEQ ID NO: 17295 - DNA, 217 bp, Homo sapiens
agggacctggattcttagtatttcaggctgctgtcccttttttttttttcatttcctttttgtttttgtkgttgatgtgaccgcgtgtccacaaccctgggattccctcgccctcagattccagaatccaatttsttggatttmagtgttttwaagybgstcgggaggytgaggsaggagaatcgyttgaacstgggaggsggaggttgsagtgagc

SEQ ID NO: 17296 - DNA, 344 bp, Homo sapiens
ttctattattttggcttcttagaacaggctgccccttaatggttataagatggctgcagcacctccaggccttaagtctcaacattaagagtagcagatatagagaaatttcctcccaccaataagacactcctggcctgattcaaactagcctgggttgggtcctgtgcttattctagagctaatctcaatgaccagaacaatgggatatgctgatgactggacagtagcccacccctaaacctgagggtggggtcaacattacccaaaaacctatgagagtttgagatgaggtggttcacctgaagaatttggggttgcttttttttttttttttttttttt

SEQ ID NO: 17297 - DNA, 330 bp, Homo sapiens
ttctattattttggcttcttagaacaggctgccccttaatggttataagatggctgcagcacctccaggccttaagtctcaacattaagagtagcagatatagagaaatttcctcccaccaataagacactcctggcctgattcaaactagcctgggttgggtcctgtgcttattctagagctaatctcaatgaccagaacaatgggatatgctgatgactggacagtagcccacccctaaacctgagggtggggtcaacattacccaaaaacctatgagagtttgagatgaggtggttcacctgaagaatttggggttgcttttttttt

SEQ ID NO: 17298 - DNA, 488 bp, Homo sapiens
tataaaggcttgttttctacccctaataatttagtctctagttttgaatatgtttgggtaaaactcaagacaagactatttttgtgtgtgaaatctattaatacctagtgtttcgctagactgttctgtagcatagcaatcttttactgtaacagtaaccatcttttgccattaaatagaagacaaaattgcttcagtgagatttgttaaaatcacaaatgctccaaaattcttttggkgctttttagatctttaagagtgggagattggggatgttaatatttttgcttgcagtagtgtacattttgtaatatagaaatagtgaaaaaaattgttattaaagtctcttcagatatattcaattattaatcatgcaacaaacatttattgagtacctaccatatgtgaaacagagttcaaggtgctatcaatacagctagtcttccaaagctcgtgaccttcagatcttttggtttagatctgttatg

SEQ ID NO: 17299 - DNA, 438 bp, Homo sapiens
agttagaactgagactctggaactaatgtcacagcatggatataatgcctagaaagtttacaatgaaaatctagttcgtatgattgaamsactcacagaaagaacttcagaagactccagtgacccttcatgagaagaacatgtctgcggtascactggtccaaggagaatgaggaaatatgtagagcagctttgaacctaatcagcagtctgaagtcaagcccagtggattccagccaagcacagcagaaccacagccaatctatagaactatgagagaggaaataaatatttgtggctataagctattgagagtttaaacttgattgataggcagcaaaaactttcaaatcaattgttcttattaaacattttgcttttgttttgttttgtttttgagacggagtgtcactctcctccaggctggagtgcagtggg

SEQ ID NO: 17300 - DNA, 372 bp, Homo sapiens
wwttttttgtgttccggccgatcccacctctcctcgaccctggacgtctaccttccggagcccacatcttgcccactccgcgcgcgggctagcgcgggtttcagcgacgggagccctcaagggacatggcaactacagcggcgccggcgggcggcgccsagratggagctggcccggaatggggagggttcgaagaaaacatccaggctctagcttcgaggatatgggtgagctgcatcagcgcctgcgcgaggaagaagtagacgctgatgcagctratgcagctgctgctgaagaggaggatggagagttcctgggcatgaagggctttaagggacagctgagccggcaggtggcagatcagatgtggca

SEQ ID NO: 17301 - DNA, 130 bp, Homo sapiens
  misc_feature 124: n=a, g, c or t
ttttttgtgttccggccgatcccacctctcctcgaccctggacgtctaccttccggagcccacatcttgcccactccgcgcgcgggctagcgsggtttcagcgacgggagccctcaagggacantggcaa

SEQ ID NO: 17302 - DNA, 209 bp, Homo sapiens
attggccccatctgcaggtcctctttgacacctaccttactctctccctccactcacactctgagaactgtgctcaggggcagcgctacaacttccacattggtctttacagggcttgagtgattatttcaagaacagaacgctgtgtggaaacctttaccatatttcgttgtatctaagacacattttttttttttkgaaattwaaca

SEQ ID NO: 17303 - DNA, 235 bp, Homo sapiens
attggccccatctgcaggtcctctttgacacctaccttactctctccctccactcacactctgagaactgtgctcaggggcagcgctacaacttccacattggtctttacagggcttgagtgattatttcaagaacagaacgctgtgtggaaacctttaccatatttcgttgtatctaagacacattttttttttttkgaaattwaacaycycwaaggtkgggtwakgttyctyc

SEQ ID NO: 17304 - DNA, 348 bp, Homo sapiens
  misc_feature 328: n=a, g, c or t
acatttagaatacctctagagtttagagaataaaattctttagaatgcattgcttgtstttagctaaacacatttaacaaccacgacacaaacggggaggagtgaagaagggggacttgaaccaaaagacctttaaaaaaaaaaaagtctgcgagtcaaaaggtcattctccaagtttgtaaataaaattgcaaagggagtccttaagaaaggagaggaaagaaggggaagaaggttaggaagactcacaagttacataaaacagtgcattggaaaaacgacagggagattctgtaataaaaaaaaaagaagattcttaagaacccangagagagaaaaaaaacctgg

SEQ ID NO: 17305 - DNA, 456 bp, Homo sapiens
actttcttctcgtctgtcgccatgtgagatgtacctttcactttcctccatgattgtgaggcctccttagccacatggaactgtgtcagtgtttggtactttaccatggcacgtgtttacatacaaacgtgaccagagaactacaacaaatvgtttacaggaggtgaagattatagaggccctggcaatcactattccagtctctgcttctatgagtttgactatttcagattccacatgtagcaaactggggctacgtttctaagaattcccttcactgaagagttccaagttactggaagaaacttggaacaaaaggagttctgcatgaattttgaaaggcctactgactcaacaggcagtcagatatgtaagatgggtataaagcggtgagagtgaggacaaacccataatcaatgtctggatccctgatgaactgagactcacattgatctt

SEQ ID NO: 17306 - DNA, 442 bp, Homo sapiens
agtcaggctgcgtccccttcaaagaacgccaccgctgagaactgaccctcacatctcccttcctgaatttctttagggaaagcaacaaccatccctgtaagccatgggktttcakgcggagggaaggagagggctagttgtctgagagggtaactgcttaaggctgcagactaggaaatgggattccaggtttaagatagctcctttctggacctcagtccttcacctagtcacctagtcacagggtggattgcctctaaggatacttaggggaaaaggaaccaaatttgggatggttctccttgctttaagccttgataggagacggggaggccaacccttctctgcagaccgtgatcctcactagacagaggagctccaaacctgcccatctcatcccatgcaccgacggtsctggcctggctccaaactcccgaaagga

SEQ ID NO: 17307 - DNA, 499 bp, Homo sapiens
acatatagcatgggtttctgggtgccaatagggtgtcttaactgtttgtttctattacgttagtttcagaaagtgcctttctacaaggttttgaagttgttaatattttctgtagttccattggaagatcgttcgtcctgtcatttatctcattttaagataaagggacgacaaaactgcagtcacttttgaagtaaggaaaacatttaggggtgactttctgagcacatttagggtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaaagacatgcagctttc

SEQ ID NO: 17308 - DNA, 137 bp, Homo sapiens
aacacgggaacacccacctttagagatgagacacaagcaggagaagagggattaaacctgctagttttggaaaaaaaaaaaaggammcgaaaagaaaagaaagaaagaaaaacaaaaaacaacaacaaacagaaaaa

SEQ ID NO: 17309 - DNA, 478 bp, Homo sapiens
gactgacggtaacggggcagagaggctgttcgcagagctgcggaagatgaagttgtggtatttgagaagaacactgagtcaccattgccacagactctgatatcggtactgctggtaggccatccatccaaatctagaaagtttctattgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcgctggatgttttgaggggtaatgatgcga

SEQ ID NO: 17310 - DNA, 124 bp, Homo sapiens
  misc_feature 67: n=a, g, c or t
gctcagatagtctctttctctgacactgtgtaagaagctgtgaatattcctaacttacccagatgtngcttttgaaaagttgaaatgtgtaattgttttggaataaagagggtaacaataggaa

SEQ ID NO: 17311 - DNA, 136 bp, Homo sapiens
gctcagatagtctctttctctgacactgtgtaagaagctgtgaatattcctaacttacccagatgttgcttttgaaaagttgaaatgtgtaattgttttggaataaagagggtaacaataggaaaaaaaaaaaaaw

SEQ ID NO: 17312 - DNA, 139 bp, Homo sapiens
gctcagatagtctctttctctgacactgtgtaagaagctgtgaatattcctaacttacccagatgttgcttttgaaaagttgaaatgtgtaattgttttggaataaagagggtaacaataggaaaaaaaaaaaamaaar

SEQ ID NO: 17313 - DNA, 181 bp, Homo sapiens
  misc_feature 140..141,181: n=a, g, c or t
gctcagatagtctctttctctgacactgtgtaagaagctgtgaatattcctaacttacccagatgttgcttttgaaaagttgaaatgtgtaatystyytggaataaagagggtaacaataggaaaaaaaaaaaaaaaaannaarraaaaaaaaaaaaaaaaaaaaaaaaaaaaaaaaaaan

SEQ ID NO: 17314 - DNA, 471 bp, Homo sapiens
atgcgctgttccccgtgaagaccacctctagatctgggagagcggttgctactcccaccctcctttctctctcagaacccaggtctttcccacaatgtagaccttccctgaccacagcaggacaagctattaataggataataacaacataacaaatactatttattgaagaagtactgcatactagaccctttacaaagcacgttccwtacagtattaggttatttatactgcacaccaatccttcaagatggttttttttctgtcagtttcacggatgaagcaggacgggacgcttcctgtcattttaccgtgacttgccccaggaggtcacacggtcaagtgaaagattcacacctatgtcggcctcctgacattcaaacctgctctgtcttaagaaccaagcttacttctccggatcagggaggaagggctagaaaggagatcaatggcagagagaggagtgggggt

SEQ ID NO: 17315 - DNA, 412 bp, Homo sapiens
  misc_feature 112: n=a, g, c or t
gacttggctggcgggatcaagtgcagctgcttcaggctgaggtggcagatagtgagcgctggtggcggagttaaagtcaaagcaggagagtaattatgaatagcgcaggtgnattctcacacctagaccgtcgcgagcgggttctcaagttaggggagagtttcgagaagcagccgcgctggscyttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattamccatgatactggagaatgtcggctagaaaaactcagcagcaa

SEQ ID NO: 17316 - DNA, 520 bp, Homo sapiens
atatagactgcatagatctttggccattgagtgcattgagttttactgtgagtaagatggggagctattagaggattttggagcagaggagggaacgatttggctgacattttagcagaatgcctatgacagctgtgtggagaatcaactgcaaagtggaaagaatggaagctgagggaacagttgagaggctattttaggattcaggcaaagatagtgatggtttggagcagtgggagcattggtggtgataggtgttgggtttggaatattattccaaggtagagttgacagaatttgctgatgaaaattttgaagaatttaaggtaaagagaagaatgaaggatgattcttggtttttggcctgagcagcaaggtgaatagtaggatggaggaatggccatggaggaagatttgtgaaagaaaattgaagatttagttttagatataattttgaaacatttattttacactccaatgaatggtctagagttcagatgaggaaagagtcasggtggag

SEQ ID NO: 17317 - DNA, 492 bp, Homo sapiens
aacataggagttacaaatcccgaaaggtgcatcggttggtttcaaagacaggaaaagcagaggtgggaccaatacctgcgctccgttgaggtaaaatagataaagagtctgcagatgtatttttaaagttcaggatgcgtcaagtggcacgcagaagctttatcacgagttccctcgcccccaaactgaaagcaaatatgacatcgtatttcctctctgaagtaaatacgattcctctctgttctcagtaaaacatcccgaagtcggcaaaagttcaggctgcgttaagtggcacgcagaagctctattacgagttcctttactcccaaactgaaagcaaatatgacatcgtatttcctctctgaactgttctcagtaaaacatcccgaagtcggcaaaagttcaggctatgttaggtgacacgcagaggctctatcacgagtttctttactcccaaactgaaagcaaatgtgagatcctatttcctcgctg

SEQ ID NO: 17318 - DNA, 84 bp, Homo sapiens
ccataaaaggctaaatgtagagttcacttataaagtgaacaggtagatctaatcagtctagtaagtccaaaaaaaaaaaaaaaa

SEQ ID NO: 17319 - DNA, 526 bp, Homo sapiens
attaatagtcttctccacttgaacatgctgtctatgaagacaaaattgaataggaaagttctcactgagatgttcttccctgcttagaaacaatcctttctaatagttaaggaaatagcaaactgtagcctgtggaccaaatttacccactgccttttggataaagcccatgagctaagaatggtttttacattttttaatggttgaaaaaagacaactgagtatggtggttcatgcctgtaatcccagcactttgagaggctgaggcgagcagatcacttaagcccaggatttcaagattgcctgagcaacacagggagatcccatctgactaaaaattcaaaaattagctggtgtagtggtacacacctgtagtcccagctactcaagaggctgaggtgggggaatcacttgagcccagtaggtggaggttgcagtgagccaagattgtgccactacacttcagcctgggcaacaagagcaagactctatctccacacacacacacacaaaaaaaaaaaaaaaa

SEQ ID NO: 17320 - DNA, 250 bp, Homo sapiens
atcgcatcagtgaagggagagcaggtgcctgggatcgaaaggacattgtccatcacctggctctgaaaaacaaaatgcatttccttattcttaacaagctgagcaccagaaacctgctttaccagtccagggtgcctcctggaagctggctcgcttatctgcatgtatgtgagggctgggggtgtttttgtggggctggctccgggcagggtggctttggaaaggagaggcctgacctagcgagactcta

SEQ ID NO: 17321 - DNA, 490 bp, Homo sapiens
gactgtgtggaagcaccaggcatcagagatagagtcttccctggcattgcaggagagaatctgaagggatgatggatgcatcaaaaggagtatcactggtgcagtcgctagaaggctctctggcaacatttgctgaaattaaagatgcccatatcctgtgacacagcaattctgctttggaagatttctcttacaaatattgtcacacatgagtgcaaagatacatgtacaaggaagtacattgtagcatataagattttaaatggtctacatgtccatccagggggataatagctactaaaaagtaacaaggttgagaccagcctgggcaacataaggagaccccttcttcacaaaaaatgaaaaaattagctgggtgtggtgatgcatgcctgtggtgccagctactcgggaggatgaggtgggaggattgcttcagcccaggaggtcgaggctgcagtgagctgtgatcacgccattgcactccagc

SEQ ID NO: 17322 - DNA, 402 bp, Homo sapiens
accgactgtgtggaagcaccaggcatcagagatagagtcttccctggcattgcaggagagaatctgaagggatgatggatgcatcaaaagagttgaggtctcactttgttgcccagsctggcgtgttgtggctattcacagctgcaatcatagctcactgcagcctcaaactcctgggctcaagtgattctcccacctcagtctcccgagtaaccgggattacagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggc

SEQ ID NO: 17323 - DNA, 425 bp, Homo sapiens
caatacgagacgagattcgagtggggacacagagccagccatgtcagcaccttatgcgtactttatccacagcatcttcccaacaacctggagatggtatcacctccaggctgtggtgaagcaagtggtgaagggagtgaatctcagggaggtgaaaatgcccagtctctccagggcccttgcaagacgtgccaaaacttcatgctgtatggagctgcttttctgtctcatgcatcctgcccttgcaggggcgctcctggctgtccagggtcctgaccattccttgtctccaggctggttccagatgggatgagttgttaggactgacggattcttctgggaagcatttgtaagatttgggatctggccagagggggagatgtccaccttatcttatggtttgctcaggtcacagtggctgtcac

SEQ ID NO: 17324 - DNA, 498 bp, Homo sapiens
attgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatg

SEQ ID NO: 17325 - DNA, 517 bp, Homo sapiens
agagcaggagccctcggtggcagtgcttgggtgtcgaggctctgaggctccggcctcacctctccacggggtcgaagggaacgtctccggatgccaggagtcgcaaagggccgaccatgatgatgaaaccccaggcagagacgggggaagcagcacgggatcccagcctcaggcctgcacggacggtgttggttgggagacgaggtctcactatattgaccaggctggtcttgaactcctggccttaagcgatcctcctgccttggcctcccaaagtgctggagttacagatgtgagcctctgtgctcagtccatccttggctgttcaagtgtagaggtaagtagtagatgccaagtttacctccaggtaagaaggggcagatgtcccagggcagaatcataaccataatcaggcctcccactgcatgaagacattatgttctgaagcttaaacctggacaaaggtctgaccagtagcactgtgttcatgaatgtcaggtcaaaaatttaaaactgg

SEQ ID NO: 17326 - DNA, 396 bp, Homo sapiens
acacaataaagaaaatgtacaaaaggctatctttcagaaatgtaccaagtccagctgtttccgsarataattctacatatctttaaaaaacttatgaccccgggcgcggtggctcacgcctgtaatcccagcactttgggaagctgaggcggcagatcacgaggtcaggagatcgagaccatcctggctaacacggtgaaacccgtctctactgaaaatacaaaaaattagccgggcatggtggcgggcgcytgtagtcccaactactcaggaggctgaggcaggagaatggcgtgaacctgtgaggcggasttgcagtgagcgaagatcgcgccactgcactccagcctgggggacagagtgagactcggtctcaaaaaaaaaaaaaaggaaacc

SEQ ID NO: 17327 - DNA, 542 bp, Homo sapiens
ttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacagatctacatt

SEQ ID NO: 17328 - DNA, 595 bp, Homo sapiens
taaacctggacttccaggtctttaagattatatgtttgtcaagctgatccagcttttcatttcgactttcatctagagttttttcactgaattgctgtgtcctatatatatgacagtggtgcaatcatggctcaccgcaacctcgaactcctgggctcaagtgatcctcctgcctcagcctcccaagtagctgggactacagagatcgctgtcctatgttacctgttttctcatgtctgaaaatcattgttttgtctacttttctagttgtttaaggacctctgggttgtttccagcatttgactgtcacgaataaaaaagttgctatacacatgtgagtacaggattctgcatggacataaattttcatttctctggagtaaatacgagtgcgatcgttggagcatatgatcattagaatgatacttatcccacaacagagcaaccaagatcattcacaccttaaaatattcccatcaatcttctgagttgtcatttgaagtgaaaaatatcccatttcttcttcaagtcttggaagagaatacagagatgaagtaacagtgggacattcaaatgggaatgtacacagactgtg

SEQ ID NO: 17329 - DNA, 541 bp, Homo sapiens
atgataatgtgggttatcctcctctccatgcacagtggaaagtcctgaactcctagctttccaggagacatatataggggaacatcaccctatatataatttgagtgtatatatatttatatatatgatgtggacatatgtatacttatcttgctccattgtcatgagtccatgagtctaagtatagccactgatggtgacaggtgtgagtctggctggaacactttcagtttcaggagtgcaagcagcactcaaacctggagctgaggaatctaattcagacagagactttaatcactgctgaagatgcccctgctccctctgggttccagcagaggtgattcttacatatgatccagttaacataatcactttttttgaggacattgaaagtgaaataatttgtgtctgtgtttaatattaccaactacattggaagcctgagcagggcgaggaccaataattttaattatttatatttcctgtattgctttagtatgctggcttgtacatagtaggcactaaatacatgtttgttggt

SEQ ID NO: 17330 - DNA, 1549 bp, Homo sapiens
acttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggagggraaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcraaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgatgttagggataagtgcttatttttaagagctgtggagttcttaaatatcaaccatggcactttctcctgaccccttccctargggatttcaggattgargaaaatttttyccatcgagcctttttaaaaatgtaggacttgttcctgwgggcttcaagtgatgggatagtacacttcactcagaggcatttgcatctttaaataatttcttaaaagcctctaaagtgatcagtgccttgatgccaactaargaaatttgktttagcattgaatctctgaag

SEQ ID NO: 17331 - DNA, 346 bp, Homo sapiens
attttggtgggcacttcctgggtgcctgctctgggtcaggcctgtggggtgaccactgagggcaggaaacctggcctgtccctccaggaagcgaagtcaacactggcacctgcagatgaagtggcagagcagcccccagctttgatggcatggggtggttggggggcacattctgcatgctcagaagagagagcaactcgccctgtggaaggagcatacagtgggagatggggacaggcccagtgacgagcaccatccggaagtgaaggctgatgggtacgtggacaacctcgcagagcagtggacctgctgctgcagcacgccgacaagtgatggcctcctggga

SEQ ID NO: 17332 - DNA, 492 bp, Homo sapiens
atggctaccgagcccgaagccgcggascggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgagaaatttaagcggggggcacagtttctaacagagcttgcacctctctgtaagatttacwgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaac

SEQ ID NO: 17333 - DNA, 447 bp, Homo sapiens
aagaattatggcgacctccgcgacgtcgccgcacgcgcctggttttccagctgagggtagatgcggttactatgtggaaaagaagaaacggttctgcaggatggtggtggccgcaggaaaagattttgtggtgaacacgctggagccatggaggtgtggtatcgccctactctctcaagagtcggaaataagtatcctggtcctgtcggtgctggaacccggcccctcccctctttgacagctttctgcttgtgtcccctggattctccagctttcactttaataaacccagttttgccctccttgcggaggattatgagttctagtgatgagaaattttttatttttctaagtaaagcgccasmrktgacccatttattttgatctatttatctcgatcttaactcatggtaatgctaggttttaatttttaccccaagctaccgc

SEQ ID NO: 17334 - DNA, 499 bp, Homo sapiens
gatttaatccttacaacaacactttgtggaggatttagattttagaggtcctaattcagtctggactctggtttcatacaatagaatctggcagtggtaaacytaaccatatggggaatggatcagaagagtatgaagtaacccagcaaaaggctggcatcttgcaaaggtggatggagccaagactcttctgagatttcataagtggctttgctgcctgaaacaaagaatagccaaatgaagggatgagcagttttccagcaatgatttgtccaagtaaaatcatggtaccatccaacattgcgagacatctgcagggtgagagctacagcaacgcctctgacaaatggaatgctgaacttgagacatgatttatgcaactatttctcacctctttattccacattccaatcttaggataacatttaaaatcttaatgttgttttcaggaatagccaataaaataaatcggctctgcttttgtcaaaaaaaaaaaaaa

SEQ ID NO: 17335 - DNA, 437 bp, Homo sapiens
aagaggggagcagccagcagtcttatgctaccactgtggctcatcctgcgacctgagagaaacctgggcaactgtgagcaccagaggccaagtcctggacagtctttaggttcttcgtagactctggaatggagctggaagctgtcatcctcagcacactaacgcaggaacagaaaaccaagcactgcatgttcccacttataagtgagagctgaacgagcagaacacatggacatatgaaggggaacaacacactctggggcctgtgaggtgcagggagagcatcaagaagaacagctaatgggtgctgggcttaatacctgggtgatgggttgatctgtgcggcaaaccaccatggcacacatttacctatgtaacaaaccttgacatcctgcacatgtaccccggaacttaaaaataaaagttgacaaaaagaa

SEQ ID NO: 17336 - DNA, 411 bp, Homo sapiens
aaagttcagatgaggtcatagtggagtagggyssgcctctaatccaacaagactggtgtccttaaaagaagagggaaatatggacacagacatagacacagaggaagatgatgtgaagacacacagggaaaacatcatgtaaagacagtcttggagtggtgcacctacaagatgaggaacatctgaagctgccagaagttgtgagagaggcatggagtaattcctttcctagcaccttcagagggagcacggccctgcctatactgataacgatggttcaacttacaatttttcaactatacaatgctttaaaagcaattcagtagaaactatacttcaagtaacgatgcaactattcaatttttcactttcggtacagtattcaataaattacacaagatattgaaaaam

SEQ ID NO: 17337 - DNA, 447 bp, Homo sapiens
agacaccaagtggcttcagcatgagtcagcggcaaacaccctcaagtcatgagctggaacgctcagaaacgatatgtaccttcaatcaaattacakaattaactaggggaaaatgaggaagaactttaggtacagacagcgagagatcttcaaaatactattaaaagaagaaagcactctcggtgtaaaaaagaagccgaggcgagcagatcacttgacttcaggagttcaagaccagcccagccaaaatggtraaatccacctccactaaaaatacaaaaattagccaggcatggtggtgggtgcctgtaatcccagctacttgggaggctgatgcagaagaattacgtgaacctrgaaggcggaggctgcagtgagccaagatggtgccactacactccagcctgaatgacagaggaagactccgtcccaaaaaaaaaaaaaaaa

SEQ ID NO: 17338 - DNA, 169 bp, Homo sapiens
aatttcaagacctgagtgttcagtaaccttaccattatgcttctgttttctttttttttggactcagacagcaaagctccctttggatgacatagatttattacttagtagtatattatgtattggctgtcccacattttgaaatttaatggactcgtggtgatcagaa

SEQ ID NO: 17339 - DNA, 481 bp, Homo sapiens
agtgcagcctgtccttaggcgtagggtaatggtgggcgacctggcagttcttgggctccttgggatcccctcgagaagcccccttgttagkgtatgarrccgtcagttcactgccagtaatgaaaacatcgtgtccttagtcacctgccattagccttttcgaaaccattttttctgttccctaagctgtcacaaatcctcctctgcatcccaggagtgccgcttggtcctcgggctcgcagcgtggcccacacctgggtcgggcctctcacggggacgctcccgccactgtgataaagaggagaaaacgtcacaggggaagggcctgaccctgctgcatccattttttagatagtactgcacgactactcgcttctgaaactgtcataagaaactgcctcagctccctgcagggtggacacacaagagcagaatctccgtgggacatctctttggagcatcaatattactacagtatttg

SEQ ID NO: 17340 - DNA, 536 bp, Homo sapiens
aacgtcctatctctactccgggtctgaccgttcagggtcttaagacattttcagtgctagcccgtgcgtctttgtttccccatctttctttagttcccttgtaagcctttgtgatcacttcaaatcctttttagaaatagcttccagatgaagaagtgaagctgcctggcgcatagatgtgttcaagtctcccttcttttcgctcaaggagagtgaagagtggatggtgccaattctagctgggaggagtgaaggacggggagggggacgatgaggcaggaggagaccacgccgccctcctgggagggggctgaytcgacccagctggttcgggtgtgcaccatcctcactctctccgcccttccagggctgcactgcgccccgctctcggcaagacacgggtgaggctcgggagatttaattcccctgctcaggtcagtgtagggcctcagggaagttcaaagctcgcccactagagggcattggcgcgtttcccagaagacacggccccgggagctttcgggctctccagcagc

SEQ ID NO: 17341 - DNA, 443 bp, Homo sapiens
ttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaccttcactgcatccttgccccattcagcccggcctttcatgatgcaggagagcagggatcccgcagtacatggcgccasactggagttggtgagcatgtgctctctcttgagattaggagcttccttactgctcctctgggtgatccaagtgtagtgggaccccctactagggttaggaagtggacactaacatctgtgcaggtgttgacttgaaaaataaagtgttgattggctagaa

SEQ ID NO: 17342 - DNA, 392 bp, Homo sapiens
  misc_feature 362: n=a, g, c or t
ccgttcaggaccccggcgcgggcagggcgcccacgagctggctggctgcttgcacccacatccttctttctctgggacctggggtcgcggttacttgggctggccggcgaacccttgagtggtcggggagcgggcctcgcgcgcctggagggccctgtggaacgaagagaggcacacagcatggcagaaaaccgagagccccgcgtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccgnggtcagaacgsgtgctctgagatctacatt

SEQ ID NO: 17343 - DNA, 301 bp, Homo sapiens
agattcatgtgtttgtggccacaggaacaactccatgttttctaaaaggcctacagaacatatatagggtgcctctgctctttccttttgcattcgttattttggtgaattactggaagatggcagttccggccaagcaggctagaatgttatttccttctgattactaaaatgcccatggcttctataccttccaaatcttctaatctccctgagcagtgcctattgattcaggtggtggtcactgaatgaaacaagatacaagcgaaaaaggaatatagagcataggtttgtgagtgag

SEQ ID NO: 17344 - DNA, 249 bp, Homo sapiens
agattcatgtgtttgtggccacaggaacaactccatgttttctaaaaggcctacagaacatatatagggtgcctctgctctttccttttgcattcgttattttggtgaattactggaagatggcagttccggccaagcaggctagaatgttatttccttctgattactaaaatgcccatggcttctataccttccaaatcttctaatctccctgagcagtgcctattgattcaggtggtggtcactgaa

SEQ ID NO: 17345 - DNA, 435 bp, Homo sapiens
atcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 17346 - DNA, 417 bp, Homo sapiens
taattcatgtcaacttgtggcattttctctaactcgctcaagtacaacatttggaggcccgagtgagaaacaccaccaggcgagatccgggctcgctccgggctcccccggaaggacggccggcttgtaggtggggtgtcacctaaaaaaaaattttcaggtccccgaaaggtgaccgtcttccagaggagagcggatcgactaccgtgtgggtgcccataaaaattccacctctgagtcctcgacttctgaccccgaggtcaggtaggtcagatttgacttcagttcttgtaagagggaagcggccctgatgagggtgtccctctcttgactctgcccgtttctctaggaagctggaaggtagagccctggttttctgttaggcacttctgtgtctctttctaggagggaagtagc

SEQ ID NO: 17347 - DNA, 470 bp, Homo sapiens
aaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcatagcataaaggtgaggct

SEQ ID NO: 17348 - DNA, 672 bp, Homo sapiens
tttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatgggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttggttttgtttaaaaatggctttataaaagggcttttataacccaaaa

SEQ ID NO: 17349 - DNA, 543 bp, Homo sapiens
aattccggccggacgtggcgcacaggaagttacgcacgggaggcggtacctggttgtggagggtgacgccatgggtggggcggasgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccgaaa

SEQ ID NO: 17350 - DNA, 257 bp, Homo sapiens
acgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaagatttttgtatccagcaagactaagc

SEQ ID NO: 17351 - DNA, 248 bp, Homo sapiens
acgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaaaaaaaaaaaaaagg

SEQ ID NO: 17352 - DNA, 476 bp, Homo sapiens
gaaatacaattttatgaaattcagttagaactatatgaagttaaatttgagatattaaaaaacaaagaaatactgcttactacacagttggactctcttgaaagacttataaaaggtaaagtttttatttaagtatatagattacaatgtttataaatttaaggaaatacagaccatattatcaattactttttgtaaactgtaacatctgaaaatttcctaaagttttccttcagtggtttattattcaaataatatattcattgttagcacatagcaaaacaaagaaagaaaaatgattattaccccaatcccatcatctagagatgctcaatggttggctgggcacagtggctcaggcctgtaatcccagcactttgggaggctgaggcgggcagatcacttgaggtcaggagttccagaccagtctgaccaacatggtgaaacccgtctctactaaaaatacaaaaatacta

SEQ ID NO: 17353 - DNA, 414 bp, Homo sapiens
  misc_feature 326,334,340,344: n=a, g, c or t
acttggatgaacatctgaggtgaaaatttcctctcgattatagaagagctgaagaacgaatgcctcggggattttgagaggcaaaagaaaaaaatgcgattcaacagtaaacatctctgtaatattgttaaaaaccagttgttattatacttgggatttttaataaagcaaattaggtggggatcatatttcaggggagagaaaattgctgtcacagaaatttttactgctgttgtcttagacacgctgaagagccttaagtcctggggagaagagcaaagttcttagaaggaaataatgttcttcagctgtttaaatcctccctngaaccatngaaatngatngcatctggatatcagcaaaggcacaatacacagaattttacagtattcggatgcagtcatgtttcgtttt

SEQ ID NO: 17354 - DNA, 502 bp, Homo sapiens
caaaatcatcgaaactgatgatatttcattaggtcatctaaaatttaccccaaccccattaaatctccactcctaaatctaatgcagacctgccatacttaaaagttgccttagaggaggtttcttactaaggccacagtgacaatacagttgctaattattagcatgatgactatatatattttcatttttacaaaacatttacatatggactcccaattcattttgtcttagatttatcctgttttatggggatcttaagtgatttgcttccacaatcatgtcccgcacaaatcgctgatagattagtgcacacacgaaaatttttgggtctaatttgaaatcatggttttgcttatcaaaacatctagtagacagaatagttgctcagcgtaccgagaatccagagtaaatgcctctgtcggcagtctgtttttgctgtgatactcaatggtgtgtttggattatagctgaccatattgtgttgtaactgtgtaggccc

SEQ ID NO: 17355 - DNA, 402 bp, Homo sapiens
gtgatagaagcatccccccagtttgtcctttatcaactaggattttcatatatgaggcttgctgaaaaaaggcagcgttgtccaggtttcctcacttggctcccaattcacccataagaaagaatgttcttgtaaaagatcatgtggttcatgatgcatttgtgcttactttaaaaaacaaagttggtcagatatccttaggaatctcttgtgattaaaattcctgggttgaaactctagaagagatttctcaaactttgaagcaattgtttagttaatatggacctgagagattctatgccttttaccaaaaaaaatatatcttctaggattactttgcagatgggacataggtaaaaaagcatggcctgaagtgaggagaagatgtgatgaatgacaaag

SEQ ID NO: 17356 - DNA, 507 bp, Homo sapiens
aagtaggaagtggtgagttcggagtagagatggccgcgcttgcaccgctgcccccgctccccgcacagttcaagagcatacagcatcatctgaggacggctcaggagcatgacagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggaa

SEQ ID NO: 17357 - DNA, 291 bp, Homo sapiens
tacttccaatattttgagcatgttcctgttttgttaaacattttaaaatttgattttttcatggctccccakatrkgsttgcacttaccattgattgagatgcaaatcagggcttggcaaactgtttggcctgtgggccagatccagccgtcagctgctaagaatgatccsttaacgtttttaaaggattggaaggaaaaggaaggattatgtgatggaaactgtatatagcttctcaaagcctggtatttgctatccggccatttacagaaaaagttttgacttctccga

SEQ ID NO: 17358 - DNA, 503 bp, Homo sapiens
ctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagcccccagcccaccc

SEQ ID NO: 17359 - DNA, 482 bp, Homo sapiens
aaaaaggttgtttctcagacctacaccttgttttgcgtttgagtcctaaacgggtagcaaggtttatatttagcactaagccgtgaatagtagagcttaaagtatcaagaagagcggttcaactctggtggaagtggaggtgttctgctttcgatgggtgacaaggagaagagcagtacaggccatagatacatggacactagccatttgaggttacagtctagaactggataaccctgcaagaactaatgataacagagtcagaaatatctacttcaaaaacctaattttttttaaaaaaaaattcttatttccctctttttctttcatagtatttttaaattattttaagactttaaccttctttggctgtgcaagaaggaaaaaacaaatagtttatgtttgggatagaatttttgaagaacaatgaggaatgcacccctgggaactggcattgatagtcaaagtaatttatgtgatgt

SEQ ID NO: 17360 - DNA, 483 bp, Homo sapiens
ataaatattttaggctttgcagtgttgttactacttaactctgcctttgtaacatgaaagcagctgtaggcaatatgtaatgaataggtatggctatgttccaataaaactttatttacaaaaacatgcaaaggcctcagttaggccctggagcagtacattgttgatctttgttttaatgttttaaatttttaattctcatggcctgtgaagtggctcatgcctgtaatcccagcactttgggagactgaagtaggaggaatgattgaggccaggagttcgaggccagcctgggcaacatggcaacaccctgtctacaaaaaattagctggatgtggtggcacgtgcttgtgattccagctgctctggaggctgaggtgagaggatcgcttgggcccaggaggttgaggctgcagtgagctatgatcacgccattgctctccagcctcagcaacagactttgtctcaaaaaaaaaaaaaaaa

SEQ ID NO: 17361 - DNA, 468 bp, Homo sapiens
cccttctttccgtcttttggaaatgaaaccctcttgccctgagctgcccatcccagcaccccctaaccacccatccagagaacacagctctggctgatcgtcgtgcctggtgacttcctcagggcggggcaatgacccaagcaggaccagtggaaatcaaccgggataattgaggcgaaaacgccaagaatgagagtctctcctttggattgcaataattaaggataggcagttggtatgccctccccggcgtttccttccgccaccggaaggaagctcatgcgagaaggaagcctccagcctggaataggggacggagctggagccacacgcgcasttgggtgagccacgcacccctcaggaccaccaagaactgcccagccaagtgagccaaaaaacaaatcacaaccacagacctctcactgaccgagctgaccctgagtttctctaatcttttaatgcagagag

SEQ ID NO: 17362 - DNA, 328 bp, Homo sapiens
  misc_feature 244..245: n=a, g, c or t
gaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtannagaggcatttattaatacagcaaaagrratttatgraaaaattcmagaaggagtctttgasattaataatgaggcacaatggs

SEQ ID NO: 17363 - DNA, 535 bp, Homo sapiens
tttaacatctatttaggttaatgttcactttacaaaggtgatgggggatattttgttaggtgatagcagatgcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataag

SEQ ID NO: 17364 - DNA, 416 bp, Homo sapiens
gatttatttttcaatctaaagtttttcacctctctctagtaagacatctgaaactcataagccatctttaagaatttcttacaaaaacatgctggaagacagtggatcttgtttgtatcctgaagatttttttctcttcgttattttaaattaattgtcaacagatgtgcmactgktwaggttggttcttaagtcactcggagaagagagagatgcatctactcaaggttggcacttggagaaacaacactgcctcttcctggcttatgaagttcagtgttctttggcttgttagtcagaactgttgcagagcaagtgttgtttggatggcttatatgaacatatcatttcatgttgggaatcatgtgttgtcagagttgggagagactggagtctttggaagaagctccactttg

SEQ ID NO: 17365 - DNA, 472 bp, Homo sapiens
ctctctctttcctgctccgccgcggtgagacgtacttgcttctcctcaccttctaccgtgattaagatgcttgcttctcctttgccttctgccatgattgtaattttcctgaggcttccccagccatgtggaactgaaaatcactatctgaaattctccattgcttctttctaaaataaaataattttatcattttgctaaaaagatgtaatacaagctgtagagcttcaattagcccttagaaagcatggctattttcatgaagtgtgaatgttctctgagaatggaaattttaagaacaggaacttaactgaaagttaagattataaaagggaaacaagaatgaaagaggaacatcaaaccacagttcattaagtgtcttcaagatgttacctacttcgtatagacttagcactccaggtggagcatggcaaaggaagattcaattcccaggctgctctccctgtggttt

SEQ ID NO: 17366 - DNA, 87 bp, Homo sapiens
aycggcatcgkctgasactgctgcstccagctagttatttcgtcstcttcctttcttcasccctacaccttggaggtgaacttctca

SEQ ID NO: 17367 - DNA, 437 bp, Homo sapiens
tatttgtactgttggggctcagaaagcgataccccaaagactggcgctttgacatgctgagaggccttcgaagctgcctcagaatcaaggtccctctaaccttctctcccaagtatagggaggcactctctctagaatttcctaatctgatcgagaaaacgtctttccaaaagaaacaaaattgccttcctcccctctccgaaatctcatctagctcagaaaagaagactgaggaaggcaactacgcctggatggatttttcacaagatgatgcctgtttctcgggctcattcaaattctaaagagaatcatttacaagttaatttctgtccattttttcgccctaagaatcacttgctgccctcagaagaattgtctatattctccatctctccmcttcccctatgaaaaagagtgtatacgcttctgtaccccat

SEQ ID NO: 17368 - DNA, 460 bp, Homo sapiens
agttagttgtacgttcgaaacctgtcgycgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcmtctccgctcccgccgccgtgtccaccgagccctgggatcagggtggcagttctcaacgatgggcaggagggacctcggcggcgacccctaaaacaataccatgccccgggatccccgctgctgccgcgccastcttccctttccacctccctgaccctgtcggattcggatgagcccattgcaaggagaagacgcagccgtcaggcagtattcaggcacacggttcaataacgggaaagaatgtcgtcacatgattgcatcatgttcttca

SEQ ID NO: 17369 - DNA, 591 bp, Homo sapiens
taatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactrttttatgctgaagtgaccatattttcaaggggtgaaacatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgcatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcaaaaaaaaaaaaaaaaa

SEQ ID NO: 17370 - DNA, 443 bp, Homo sapiens
agttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccastcttccctttccacctccctgaccctgtcggattcggatgagcccattgcaaggagaagacgcagccgtcagagcgcctgcgaggtggctaaggcttggagagcatacgaggcggaatccggatcg

SEQ ID NO: 17371 - DNA, 250 bp, Homo sapiens
gataaattatgataatatatgaggaggcctcgctatagcaaaaatagttaaaatgctgacataacgccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaaaaaaaaaaaaaaawwwaaaaaaaaaaaaaaaaaaaaaaaaaargct

SEQ ID NO: 17372 - DNA, 50 bp, Homo sapiens
ctcttcctgytstscatsatggcggatcaaggtgaaaaggwgwaccccat

SEQ ID NO: 17373 - DNA, 502 bp, Homo sapiens
gaatcttccttagccaccttccagtagtttggtgtgcttatttctatcctaacaatcaatttgggggtatcttttaaaattgcagaaattgtatggaattagaggaaacaaagccacgttcaaattcttataaaaattttaaagtgagtggcttaatttcatctgtaaagtggggacaccatctaccatgtagttattagatgtgaataccagagaaaatacatgtagaaagtgctagtgcctgccacatactatgtgctcaataaaactcagtgttttatatgcctatctccaataaatggcagaaaagactaacctgtctcagagtkcctggctcatagcaagtaccatgttcatgtttcaaaaaacagatgaaagacaacaagaaagtcacattctaaagcttttcaagaaataaagaagtacaaacaaagtttcttcatcattctatttattacatgtatgaatattaacatctcatggtgtccatctaagtcaaaac

SEQ ID NO: 17374 - DNA, 479 bp, Homo sapiens
agctccctgcgagtggcgcagtaacagaccgcagggcaagacagccggcgcgggaggaggatggcgctgtcggtgctgcgcttggcgtgctgctcctggcagttaccttcgcagcctctctgatccctcaatttgatctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataat

SEQ ID NO: 17375 - DNA, 501 bp, Homo sapiens
cagattgtatttggagataggcagggcctttagaaaagtaattaagttaaaatgaggtcattagtatgggccctaaaaccaaacctgtggcaccttgatctgagactctggcctcagaactgtgagcggatgaatgtctgttgcggaagccacccagtctgcggtattttgtgatggctgcctggcaaactgatacaaccactcacacacagcaaactgcacagaggggcatgaatacaaatgtgaatgttatagcaggtgcaggttaagggaagtgagatatacaaaaaaaatgagattcagtccaagagctgggtctgggcattggctagatgtctgactttgagcaagttccttaactttttgagtttcagagtcatcaactgggctcatgagaaccacaagaaacctacgaaggcactgkgacagagcctggctgctggtaggtgctgcacagtatccatcctccctgtcctctgccctggctgtgtgtgctctttc

SEQ ID NO: 17376 - DNA, 434 bp, Homo sapiens
atgaaagttgatttgttttaagtttttgcctcactcctcagtttgccttcactttttctttagattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagactgcacaggatgtcattcagcagacc

SEQ ID NO: 17377 - DNA, 441 bp, Homo sapiens
agcaccaagggatgaaaatggaaaaagaagaataaagagaaatgcttcaaaggagattgttccaggactaccagtagttctctactaggtttacaagaactgatccagcaatggaatacaaatgcactagtgatcccagccaagataccagaacctgaccaagacaatgttttgctgctgttatccagaattaacctttgattttgaggattgactttaaagtttggcagaaaagaagcagagtcaaggaccaggaattgcttcagtaaagttgcaagataccaaatcaacctacaaaaatgaatagcatttctatatcatagaaatgaaacagctgaaacaagagagcaatcccatttacaatagctacaaaaaaaagggatcaatttcaccaaggagataaaaaatctctataaggtaaaaaccataaaacactgatga

SEQ ID NO: 17378 - DNA, 504 bp, Homo sapiens
  misc_feature 483: n=a, g, c or t
aagattcaagtgaaccagggaaggagaatgacatcagactgggcttgtgcctgataattcatttctgaagtgcttcaagattgacgcatcagatttgcacaatgtscactttaggagattatttcttccttccttcagccagacagaagactgcagtagggcaataacagagaaatagaggccaccatctgtgtgaatacttcactgtgattatctctcaccatcatcaaatagttcagagcactgatcctcacgagttggacatttccccatgaaacagtagccttctgagttcttgcaaggaaatccattgaccctgaactggtccttaggacaggcaggcgagtggccagtgcacatctcaggaaaatcacattcatctttcgccggtctgcatatggaccctgctttttttatctgttgaggaaaaacaaagagactaaatcctggatacatttagggtcatactgcttccctgtactngaagtgtgatgtgagactatt

SEQ ID NO: 17379 - DNA, 480 bp, Homo sapiens
actcctgcttccctttgtctggcggccccgcgggattggccagagctggcgccgagggactgcagagccaccccccccgtggctcctactgcgcacgcgtgaaaaaagccagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagac

SEQ ID NO: 17380 - DNA, 446 bp, Homo sapiens
agttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagacaaaaaa

SEQ ID NO: 17381 - DNA, 454 bp, Homo sapiens
attattactactgaaggaagaacgccagatcagaaaagggagctcaggtaccttccagagagtgagacccagcgcccttgtctcgcacccagtaggctttcatccccgccatggcgagctgatccagaagaagctacagggagaagtggagaaatatcaacagctacagaaggacttaagtaaatccatgtcggggaggcagaaacttgaagcacaactaacagaaaataatatcgtgaaagagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaa

SEQ ID NO: 17382 - DNA, 488 bp, Homo sapiens
cacgcgggcgggcgggcgggcggagagaagtcgggatcccgaggggctgcggggtgcgagaagcatcctgtagtgagcggcctcccagctgactgtgaagggtgctgagcagccggggtgcgggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcaaaacgtgaaaatgtgaagaaagctactaacttagctgtattctcatgtaaatatttttt

SEQ ID NO: 17383 - DNA, 481 bp, Homo sapiens
tcccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaaagctttatc

SEQ ID NO: 17384 - DNA, 474 bp, Homo sapiens
tcccctttttcctggctctggagcttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaattctctaagc

SEQ ID NO: 17385 - DNA, 149 bp, Homo sapiens
agtaagaagccagcagggctggtgctggggcttcttctcctgaaggggctgctgagagctaaacccagcaattttctatgattttttcagatatagataataaacttataaacagcaactararaaaaaaaaaaaaaaaaaaaaaaaaa

SEQ ID NO: 17386 - DNA, 481 bp, Homo sapiens
catttgctgctccctcgctgatcgacgcccaaaccttttatatactatgtttttcctacctacatatctatgatcgagtttaatttacaaaataggcgcttactaaggaagcgattaacaacaataacgaataataaacacaacaattgagtcaaataagggttacttgaacacaagcactgcaataccatggattggtctgataactaacagctactaagagactaatgggcaagtagcatctacagttcagatacactgaacagccggagattcacaggccgggaggggtgaagcaagacggtgtgagatttcatcacgccactcagaatggcaagcaactgaaaacatgaattatttctggaattttcagtttaatatttttggactacagttgaccgcakgaacagaccctgattgtttggaggagtctgaaggtatgcaggctggcagaaggaagctggcttggatgaacatcttg

SEQ ID NO: 17387 - DNA, 480 bp, Homo sapiens
amaatytwmcttccawymwttwaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaaggaatcctttcacgtttttcccaactttaaaattaaggattctcaggtccctgtgtagagcagtgaaaataagatgtgcgtatgt

SEQ ID NO: 17388 - DNA, 318 bp, Homo sapiens
tttttctctgccgcatccacatgttgaacggagtttaaagtctgcagttggctcctgctaatgtgatgcatggtttcctgacttcagctgccgcgtccgcttcgggatgtaagtggtctccagtgggcagaggtggaaggaaagggttggtgatgaagctgggaatgtttctgacacaacaaaccttttaaattatcagtctccccaaggagaaatgcggcttgtttctgggaatgaatggatacagagttaactgagtcacaatttcaaaccatttaagttcctctacaagagtcaaaaaaaaaaaaaaaaaaagct

SEQ ID NO: 17389 - DNA, 304 bp, Homo sapiens
tatttttataaagataatttttcatgcctccactatttggttatcttgaggtatctcttacagaaaagggaggataaatgcgttaattcttctccattatttactaggtttcacataattaattgtttcgctaatatccttcaaaagtagcccaatgaagctgggcatgctaggatgggcctgtaaatcgtagctgctcctgaggctaagatggtacgaacctgtgagcctgggaggtcgaggctacagtgagccatgatcacttcactgcactactctgtctctttaaaaaaaaaaaaaaaaa

SEQ ID NO: 17390 - DNA, 232 bp, Homo sapiens
tttctaacttgctttcccgtttttcacatggtttcaaaccttttccactgtctagcaaactctttcttcacctttcatccactgcatatgactcttggtttaaagaagtagaagccaggtcatctggcctaccagagattcagagaaatgctgcagagagtagtcagtctttttcagtgcataattgggctggcaagaaaaggccagaaactaccaaaaaaaaaaaaaaaaa

SEQ ID NO: 17391 - DNA, 467 bp, Homo sapiens
ccctacccagcagccctcgcgcggtccggcacagcggacaccaggactccaaaatggcgtcagttgtaccagtgaaggacaagaaacttctggaggtcaaactgggggagctgccaagctggatcttgatgcgggacttcagtctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcgkctccgcaaataccactgaagaggacacactctgcacccccccaccccacgaccttggcccgagcccctccgtgagaacacaatctcaatcgttgctgaatcctttcatatcctaataggaattaacctccaaataaaacatgactggtaaaaaaaaaaaaaaaaaa

SEQ ID NO: 17392 - DNA, 300 bp, Homo sapiens
  misc_feature 181: n=a, g, c or t
accaggactccaaaatggcgtcagttgtaccagtgaaggacaagaaacttctggaggtcaaactgggggagctgccaagctggatcttgatgcgggacttcagtcctagtggcattttcggagcgtttcaaagagagcacgagcgtctccgcaaataccactgaagaggacacactctgcncccccccaccccacgaccttggcccgagcccctccgtgagaacacaatctcaatcgttgctgaatcctttcatatcctaataggaattaacctccaaataaaacatgactggcaaaaaa

SEQ ID NO: 17393 - DNA, 413 bp, Homo sapiens
  misc_feature 258,293: n=a, g, c or t
agttggtgagtgtccggccccagtaccagtgaaggacaagaaacttctggaggtcaaactgggggagctgccaagctggatcttgatgcgggacttcagtctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcgnctccgcaaataccactgaagaggacacactctgcnsccscccaccccacgaccttggcccaagcccctccgtgagaacacaatctcaatcgttgctgaatcctttcatatcctaataggaattaacctccaaataaaacatgactggtaaaaaaa

SEQ ID NO: 17394 - DNA, 579 bp, Homo sapiens
tagttcttgcagtaaaacaagtatcctctataggctggttacatcccacatctatttagcattggtataaaaagacatatgagaaacggttctgcactcaaagagctcttacttgagggccagagacatgcttgtaaggcagtaatgtacaaatcatggaaaactctagtgtgataacttagcagaaaatgcttgttttgatgatatcagagaacccatttcaaaagcagtaacatttgatttgagtcttgataggtaacgaggtttcctgactaaagaacaggagacaagtgctgtctgcccagggtatttgtagagggtgtgagaagaccagcagctggtggtgggtggggctggagggctgagattagagacaggctgggccacaccgggcagcatgtgccagtctaagccgtttcagctttctcctgggcagtggtcagccatgtacattacatgcatgcttcccttcactacatgttcttttatattgaataaggaggatgtgtaatacattaagatagccttcataggaagatytgccctaatttgttgttwtatgtgacttctatgcagcac

SEQ ID NO: 17395 - DNA, 97 bp, Homo sapiens
cttctccgcctccgcctcctcmmgacgcmrgcgmmgctttcwggaagrttcgtgaaggcagtgagggcttaccgttattacactgcggccggccaga

SEQ ID NO: 17396 - DNA, 464 bp, Homo sapiens
taaatatgaccactacttgatcccaaacgccctgctggagctggccctgccgcttatggagcaagacagaaacgaagaggccatcaaacttttggaatctgccaagtaaggcttgggtaacctcagtctgtcctttgctccctctgaactcagctcaggagctggctggggacagagttgcccagagagcagtgagtggagttgctagcaaggccagtctggcagtctagagggtggacctgtgtccctcggaatccagctctcgcctgtcataggaagacttctttcttaatgtataaatgcgcagttagactcccagaggcaggaagtaagttcccaaggtcacatcagaagccaactgcatggctgtgtgaggacccatgcctcctgccttccagggtaggggtctattccctaaaaccaccccttcaagcttaggaaccaggaggaccaggagtggttcc

SEQ ID NO: 17397 - DNA, 201 bp, Homo sapiens
tataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatggagaaaa

SEQ ID NO: 17398 - DNA, 457 bp, Homo sapiens
atattcctatcttgatatcaaactgtaagttataagaaaaacatgtttggatagttaagtcatttagggtggttctgctatggattcctgtttcaaatagaaagttaaagatagctttcttatatactctcaaacttagttaaatgagactaaagctattacttaaaatgtcaaatttgggccaggcatggtggctcacgcctgttgtcgcagcacttagggaggctgaggtgtgaggattgcttgagccccggagttcgagaccagcttgggcaacgtggtgagactccatctctacaaaaaataaaagtactagccgggcgtggtggcatgcgcctttagtcccagctacttgggaggctgaggttggaggattgcttgagcccaggaagttgaggctgtagtgagccgtgattgcactactgctgtccagcctgggtgacagagcgagasctgt

SEQ ID NO: 17399 - DNA, 532 bp, Homo sapiens
taaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggtggcccttcaccaccctgttgtcacctgcacaggcactcccccatttgcagatgaagaaatgttcagagaagaaaaatgatggaccaaacgtctgtttgcacaattgaaactctaccagtggactattctattttccc

SEQ ID NO: 17400 - DNA, 493 bp, Homo sapiens
  misc_feature 467: n=a, g, c or t
gtcttcgccctccgtggatggaggctgagcgcctcagcmattttagagctctggaaattttattagcattttaaaatttgcattctcgaccgaagattaaagtgcaaattactttgaagatgttttaaagcacgcttaagaattttaaaaaatatgcgcaggtggaaaaaagcgcgccagggtttgagatttggtccgtctgtggttttgtttttttgaaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagggtctcgttctgtcgcccaggctkgagtgcagtgacgcgatctctgctcactgcaaacctcngcctcccgggttsaagcaattctcct

SEQ ID NO: 17401 - DNA, 560 bp, Homo sapiens
agaatgtcctaagatatgcagttggcaagctggagacccaagaagagccaatatttcagtttgagtctgaaggcaggaaaagactgatgtcccatctcaaagcagtcaggcagagggagttccctcttgttctcactcaaggaaggatgagtctcctgaggttcagaagggtgagatgacacattcaagatcacatggctcatttgtgttggagtcagaagtttccagatttcttgacttttagtccaaggagcagtccctgtgcatgtgtcagagttgaacaagccagctggactgagtgcccatgacctcagggacatcttggaagctatatgtagaagatggaaaagcctctgtcatctccatcaatttaatctccaaataactacttagaaaagggacagcttactaactccttcattgcccagtactattagctaaaaacattataacaggagattcaaattctacatggtgggagcaaaagtggatcttgtttttctatagcaacatggttgaccttcatagtgaagtttgaatctgacagcattcatgctcaa

SEQ ID NO: 17402 - DNA, 741 bp, Homo sapiens
acttccgctgctgtttcgtagccgactgctgaaggctggtttgcgtcgacatggcggttaccctgagtctcttgctgggcgggcgcgtttgcscgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcasggcaccttgtttcttcttacccgttgttaggggcgcacgtcaggtgttcagctccccgggaccactggtccttcattagtgacgtatttmatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttaca

SEQ ID NO: 17403 - DNA, 412 bp, Homo sapiens
atttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacaacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggagtggagttgctgggtcatatggcaattcatttgaggaactgagaagc

SEQ ID NO: 17404 - DNA, 285 bp, Homo sapiens
aagctagggtcgccgccactgccgcagaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaacgtaagtgtgctgtgaatagggtctcatgcaatttggagaaacaaaaaaaaaaaaaaaaa

SEQ ID NO: 17405 - DNA, 398 bp, Homo sapiens
cctgcagattttccagcggatcccccggtggcctcatgtcgcgcagtggaaccgatcctcagcaacgccagcaggstcagaggcggacgcgcagcagcaaccttccgggcaaacggtaactgcaccgcggcagggactcgctggggcgcggascgagccctccccttccttaggaagctttcgtcccctccgaagttggaacgctcatcccgagccagaccgacaaggcgtacagtctgcaggcctgtacgagcagcaggccaattggcgctgggaaagtccaatcctgggsctctagctcctgagcgggacarggccgagagggcgctcccgagcttgggcctgctggtgggtgagacccargagagarggagctagagagctctgaggactgatct

SEQ ID NO: 17406 - DNA, 386 bp, Homo sapiens
agattttccagcggatcccccggtggcctcatgtcgcgcagtggaaccgatcctcagcaacgccagcaggcgtcagaggcggacgcgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccckctgtgtcwddgggccatccgagccarcggagaggtaagcctgtagagccctgcatctgcagctgggccacggggagtagttccctcttagaactgtcctccamccacagggatagtgaacctccttctgggtcatatc

SEQ ID NO: 17407 - DNA, 174 bp, Homo sapiens
tataaatataaatatataaatacaatatgtgaagacatcttcttggtttttattttgaaacaatttttaggcttgttccgggggtctctgtgctgcctgtactgtattgacctgttttataggtgcctttttattaaaaagaaaattcaaaatccgaaaaaaaaaaaaaaaaag

SEQ ID NO: 17408 - DNA, 440 bp, Homo sapiens
acattcaaatgactcagtcagcctaaggaaggaatatcagtgaagctcagccaatccaaataatgtctaattggtaactggttatttcagcaataggcttatgcaaaatgccaagccaattagacctgtggagactcagttacaaagatttgtaaggattgtttgaaaggattgttgttaagaagaattttttttttctataggacttagttttgagagaatgtaagcctgaagatgcttggaagcaagagagatgagagacaatttttttgtttctttcaataggcaagacatggaatcagcatagaaaaaagcaggactgaatgaagagtcaccaytttgattagattgtttaaatttccagcattaattctgcagtgcctctccgcaagaggctctgggtctgtgttgctgaattggcctgtgtcctcaaagcacgt

SEQ ID NO: 17409 - DNA, 547 bp, Homo sapiens
ttactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctgtgactcaactggtccttcactgccaaacatacctggggttggatcattggcctgacgtttgcaaattgaggaaccttagggcaaatcagtgaacttctgaactgccttcgtcttcagttatatggggatttccccacttttgagatccttgtaaggattatatgagatgaagagatgagacaaggtatataaaagtcctagcacagagcgtgtcatataatatggcttcacaagtaccctcatctcctttccagtcgttttttgttgttgtttttgtttttttgagaccatctcactctgttgccaggctggagtgmtcttcatttttatttctttattcagcagt

SEQ ID NO: 17410 - DNA, 473 bp, Homo sapiens
  misc_feature 265,308: n=a, g, c or t
cagcgagaggctctgaggctgccagagtggttgtgtctgttcctccggtaaggggtgatttgccgaggggcgcggaccagacagacctcgggtcaggcccgggaaccccgagaggagagcccagcccctggtggaggcggcttggcggagattcggagccgtcagcaggtttggggagaaggaaacgagtgttgtggggggcgtgggtgcggggggtaggccactgckcacacccccggctcgcaggggacgctccgggtttgtnggcggctctcggggcctgtbgcaccagcttttgartattthhngcggtgtcaagtcttcggcagcgagaggagcaaagtccgaagaatgaatggatggtgaacgcctggacttggttttgttagagtgggagatgagccgtggttgttagtggaaggtgttcacgtgattgtgaagcggcattttggattttgtcaaaagttaacagt

SEQ ID NO: 17411 - DNA, 452 bp, Homo sapiens
tttttaacccggagccccgcccctcggstacaaaaccggagcctcgggccgggctgcgtgagggaggagggttcatcatgcctagtggcgtataagaagaccccgscamcsgktccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccccccaaaaggaaactgtcatcgataggaatacaagttgactgcattcagccagtg

SEQ ID NO: 17412 - DNA, 240 bp, Homo sapiens
ctctcggcaagctgctgcagcgctagacgccgccccgccgctgcccccggggaaggagcgcmscccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaaaaaaaaaaaaaaagg

SEQ ID NO: 17413 - DNA, 223 bp, Homo sapiens
  misc_feature 126: n=a, g, c or t
ctctcggcaagctgctgcagcgctagacgccgccccgccgctgcccccggggaaggagcgcmcccagaccgtcctggcttcgaacccagctcttccaccttcagaccaccaccgcatattctgagntcattttccccgtctgcacagtggggataagaaagcctacctcacgttacgattttatacataggataaacgcaagattaaatggatatttgcaaaa

SEQ ID NO: 17414 - DNA, 225 bp, Homo sapiens
  misc_feature 107: n=a, g, c or t
ctctcggcaagctgctgcagcgctagacgccgccccgccgctgcccccggggaaggagcgcagcccagaccgtcctggcttcgaacccagctcttccaccttcagancaccaccgcatattctgagcctcattttcscsgtctgcacagtggggataagaaagcstasstcacgttacgattttatacataggataaacgcaagattaaatggatatttgcaaaa

SEQ ID NO: 17415 - DNA, 228 bp, Homo sapiens
ctctcggcaagctgctgcagcgctagacgccgccccgccgctgcccccggggaaggagcgcacccagaccgtcctggcttcgaacccagctcttccaccttcagaccaccaccgcatatttctgagcctcatttttcccccgtctgcacagtggggwtaagaaagcctacctcacgttacgatttttatacataggataaacgcaagattaaatgratatttgcaaaa

SEQ ID NO: 17416 - DNA, 225 bp, Homo sapiens
ctctcggcaagctgctgcagcgctagacgccgccccgccgctgcccccggggaaggagcgcmscccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaa

SEQ ID NO: 17417 - DNA, 225 bp, Homo sapiens
ctctcggcaagctgctgcagcgctagacgccgccccgccgctgcccccggggaaggagcgcagcccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaa

SEQ ID NO: 17418 - DNA, 224 bp, Homo sapiens
ctctcggcaagctgctgcagcgctagacgccgccccgccgctgcccccggggaaggagcgcmcccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttgcaaaa

SEQ ID NO: 17419 - DNA, 225 bp, Homo sapiens; identical to SEQ ID NO: 17416

SEQ ID NO: 17420 - DNA, 225 bp, Homo sapiens
ctctcggcaagctgctgcagcgctagacgccgccccgccgctgcccccggggaaggagcgcagcccagaccgtcctggcttcgaacccagctcttccaccttcagaccaccaccgcatattctgagcskcattttccccgtctgcacagtggggataagaaagcctacctcacgttacgattttatacataggataaacgcaagattaaatggatatttgcaaaa

SEQ ID NO: 17421 - DNA, 225 bp, Homo sapiens; identical to SEQ ID NO: 17416

SEQ ID NO: 17422 - DNA, 225 bp, Homo sapiens; identical to SEQ ID NO: 17417

SEQ ID NO: 17423 - DNA, 224 bp, Homo sapiens; identical to SEQ ID NO: 17418

SEQ ID NO: 17424 - DNA, 504 bp, Homo sapiens
aaaaaaaacacaaccacaagttatgcccgtgctgtgcctctagcagcaaagacaagcggtgtggggttggatgaatctacacttctcgtcgggggagaaagggtattttcctctttagcataagccatttacatagtgtctttagaccagagtttaaattcagcaggaaattgtagcttaatggttttttttctcttttcctctatatcttttgaaaagaagtctttggaattttggagaaagagaaagggtcattaactaccagagtttgcgcastaaaataaattattgtccaatgcactgctcatgatctagaaaagtttgcagtaggagtgaagcgcaattgtgtctgctaaaaagggacaatggtgactcgtttgtaagatgcatatggcaaagattagaaccaaagtcctttgtatatatagcaaatgttaaagaaattgttgcttatttacatccttctgaaatttttgaactccactctattaaaattattaaatt

SEQ ID NO: 17425 - DNA, 578 bp, Homo sapiens
  misc_feature 550: n=a, g, c or t
tattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaatnatttgtgtcatttactagacgtgatttt

SEQ ID NO: 17426 - DNA, 432 bp, Homo sapiens
  misc_feature 223: n=a, g, c or t
accctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcasccgtggagtcggctgagggawaagckaggcaaggcaggcgggtcgtcaaagtcctacatttnagctttcagtgctgaacttccttctcccttaaattattataaacttttgctgctgtttaataaacgtgaagatgtctcgcagtcctgatgcgaggaagaccctgtggagtgccctctttgcatggagcccttggagatagatgatatcaactttttsccttgcacctgtggctaccagatttgccgattttgttggcatcgaattcgca

SEQ ID NO: 17427 - DNA, 399 bp, Homo sapiens
acctgaacttggctcagctgccgggctgctccggttggaaacgccaagccagctgcgtcctaatccaaaagccatgaacagcggcgtgtgcctgtgcgtgctgatggcggtactggcggctggcgcctgacgcagccggtgcctcccgcagatcccgcgggctccgggctgcagcgggcagargaggcgccccgtagcagctgagggtatcgcagagaacggatggcgagtcccgagcgcacctgggcgccctgctggcaagatacatccagcaggcccggaaagctccttctggacgaatgtcatcgttaagaacctgcagaacctggaccccagccacaggataagtgaccgggactacatgggctggatggattttgccgtcgcagtgccgaggag

SEQ ID NO: 17428 - DNA, 496 bp, Homo sapiens
cttatttgggtcactggtccatcaaagccaagcctgggccagccaagtacaaggcctgctggagccttggccgctgtagctggtgggaaacaagaggccaggtgtggggctggacagtccaaggagccacatccggggacaaaacaagtgcaggggacatccatgcaggtcttgatgccagggagttagggaattggggtcctggcagggaagcagggctgggagctggctgcaagaatgaaaggaagactcagggggaggggcaggaaatagaaagggacatgtagggggagtgctgccgcccacttgcagcctgggggcaaatctgccagagccaggccgttctgggctcagcaaagctggtttctgggagccttcttcagtagggtggggtgggaagaccgaggtgcaggctgctttgggaaaagagtttcccatattcctaacgggagttagggcaggccaggtgcagtgcctcacacctgtaatcccagaa

SEQ ID NO: 17429 - DNA, 249 bp, Homo sapiens
  misc_feature 204: n=a, g, c or t
aaagtggggatgctctagaccgagtactgcccccagtgtctttccacctcctcctgcagcagcggcasgcagcagcagttagcagcggcaacttgaggctgcaccccgggcaagtccccagggtggtgctcagccgagaggggggcttggcgccccgaagkgtgttggtagggtgggggcgaccagctgggaccagckttgggncctgggaaaaacctcccacacacccacacccacacaccccttttg

SEQ ID NO: 17430 - DNA, 337 bp, Homo sapiens
tagatgttaattctctcccttggcatccggttagccccccagggggsmargcattgtggagaacttgatatttagttactgatgctcttccaggacacgaaaagaacccatctttgaatatcaatgatttttttttttttaaagtactgttccggggagaaaaacagtctcaaaacttgaacttcttgggaagagaagtgtkgggctgagaggtaacattcccaggaaatagtgagaagctcgccctgtgtttgaaaccgtgtgggtctctgtgttcctgggaagaaaacagggagcagcatcttttaaagcctgtccttaaaggtgtctcgttaga

SEQ ID NO: 17431 - DNA, 391 bp, Homo sapiens
caggatgttcaacttgctttcttggatctttttgaatttcgaatttggccatagctgaccacttgcttttgcatcaatacttcaaagggttcaaggccaggtgcggtggctcacgcctgtaatcccagcactttgggaggccgaggcgggccgatcacgaggtcaggaaatcgagactatcctggctcacatggtgaaacctgtctcgactaaaaatacaaacaattagccgggcgtggtggcgggcacctgtagtcccaactactcgagaggctggggcaggagaatggtgtgaaccgggaggcggasttgcagtgagccgagatcgcgccactgcactccagcctgggcgacagagcgagactccgtctccaaaaaaaaaaaaaaaagg

SEQ ID NO: 17432 - DNA, 427 bp, Homo sapiens
gttgtcactcgactaccaagatggcggcccccgggagctgtgctctatggagctattgcggccgtgggtggtcgcgggcgawkgcgggggctgccagctcctcgggcttcgtagctcttggcccggggacctactaagtgctcggctcttgtcccaagagaagcgggcagcggaaacgcactttgggtttgaractgtgtcsgaagraggagaarggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggargcacaggtgacattgcattccggttccttaattatgttcagtcccagcatcagagaa

SEQ ID NO: 17433 - DNA, 391 bp, Homo sapiens
tattttttacattttgctttagaggcagggtcttggtctgttgcccwcactagaatgcagtggtgccatcacagctcactgcagccttgaacttctggactcaagcgatcctcctgcctcagctagctgactagctgggaccacaggtgcttagcacgtagcctggctgatttttcctggtctcattgttgctggggctggccttgaactccaaacctcaggcaatcctccwgccttggccacattttatgttgggattacaggcctgacccaccatacccagcctaatactatttttaaaaacaaaaagtaggaaatcaattttccttttaaatgaacactaaattataagaattaacttgggtaatctatgcaacattctcactttttt

SEQ ID NO: 17434 - DNA, 82 bp, Homo sapiens
acagttaactttaggaccatagccamaagatagaaacagcataaacgccaaaatamaaagwhgccaataaagataaacacaa

SEQ ID NO: 17435 - DNA, 448 bp, Homo sapiens
ttagcagttctcgctcaccgcgctastgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgaccgggaggaggggtttgaccgctccacgagcctggagagctcggactgcgagtccctggacagcagcaacagtggcttcgggccggagaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgcccagcgcgcctgctgatgcctag

SEQ ID NO: 17436 - DNA, 353 bp, Homo sapiens
gttgagatttcctgggaataaaatggcttagttgggcattggacagtgtagttaagtaaaccctatcttgacaaaatgattcagatatgtgcttatattcttaggtgaccgggttattgatgtgggatctgaatggcgaactttcagcaatgacaaagcaacaaaagatccatmtcgagttggagattctcagaatcctcttctgagtgatggagatttgtctaccatgattggcaaggtaataagtccatttggcaggaaataccaattgcagagtgaccatagacctgagagtttgggaactttgcaaaagtatcagtcactgcaccagtggggaatcttgacctgtctaa

SEQ ID NO: 17437 - DNA, 497 bp, Homo sapiens
gatcggcccggaagtgctcacacgtgtgctccctgccctgctcctggccccttggccggccgggctgtttctgsccatgggtcgctcccgccggacaggcgcgcaccgagcgcactctctagcccggcagatgaaggcgaacggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgascagctgagcgtcgagccctacagtcaggaagaggcggagagggcagcgggtatgggatcctatgtgccccccaggcggctggcagtrcccacggaagtgtccactgaggtccctgagatggatacctctacctgacatggmctgaagatgcag

SEQ ID NO: 17438 - DNA, 507 bp, Homo sapiens
cattattatctttatgttatagtataagttttgaattatcccagctttttgaaaaagcatgtaatttactgacatactattctttattttttaaaacaacgtaagagatgggcttattatgatttttgattatgaagacgaggatgttgagacccctaggcattaagtgacttgcctaagattccctagttaattcaaattgaagtaggggtttaaataaatattaacctgaaagtatccctctcaacccatttgaaatatgtaaatcataatatttattaaacataatatttattaatataaataatatctatttcaagtgggttgagggggatagtttcaattaaatttaaggcaaatgtataaccatttgaatggcgctatgtgtaacttgattgatgccatcatctttcaaaaattataatctactcatgctacactcttgctgaaaatacacattgactccgttatctacacaataaaatctggatccacagataagagtaa

SEQ ID NO: 17439 - DNA, 447 bp, Homo sapiens
gactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagccaggtgcgatggttcacacctgtaatcccagcactttgggaggccgaggtaggcacttgaagtcaggagttcgagaccagcctggccaacgtggtgaaacctcatctctactaaaaatacaaaaaaaattagccaagcatggtgacgcacgcctgtaatcagctaattaggaggctgaggcaggcaaatttcttgaacctgggaggtggacgttgcagtgatctgagattgtgc

SEQ ID NO: 17440 - DNA, 383 bp, Homo sapiens
caacaattccctgaggtaccgtccccattttacgaatgaggtgactgaggcacaatgaataagtaactttcccaagattgtatagctagtaagagagattcaaccaggtagtatgtcttgaaaactgctcttaccactraactgtaaatgttcaacamaaagtgaaagctggctgggcggggtggctcatgcctgtagtcccagcactttgggaggctgaggcaggtggatcacgaggccaggagtttgaggccagcctggtcaacatggtgaaacctgtctctgttaaaaatacaaaaattagttgagcatggtggtgtgcgcctgtaatcccagctacttggggggctgaggcacaagaatcgcttgaaccggggaaagcg

SEQ ID NO: 17441 - DNA, 404 bp, Homo sapiens
aagtttgtttattttgtttttagtttttggggtccccgtgctgctgcaaggcgaaacgggagggagttacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatmttcacgggcttgtgttgccccakgtactgkcaaaggcagtatttttgtgtttytgcaggagttttgcacaaaatctgttcccatgcaaaccaatgagggagaagtatcggaagaaagcagttccaagatggaacaggaggattttgttatttgaagggcatggcaagactccacctcct

SEQ ID NO: 17442 - DNA, 131 bp, Homo sapiens
tatataaaggagctccgcgtgcggaggcctttcggagggtggtgagctagtctgcggacgctgtataccctcctccacttcccgctgcagccaataaaggccgttcctaccataaaaaaaaaaaaaaaaaa

SEQ ID NO: 17443 - DNA, 349 bp, Homo sapiens
cttttcggagggtggtgagctagtctgcggacgctgtataccctcctccacttcccgctgcagccaataaaggccgttcctaccatagtctgtgtccgcgttcttttttccgggactgcagagttcggggaagctgtacgccgcctttcactacgcggaatttgcagatcttcccctggacctcaggcctctccggctggagtagggtggactcttcacataagcttctctggtcgaacttacccgaatctccagatggccgcgctgcgtcgaatgctccacttgccgagcctgatgatggggacgtgccgcccctttgcgggtagggaggtgggggcagagtggagag

SEQ ID NO: 17444 - DNA, 118 bp, Homo sapiens
ctttcggagggtggtgagctagtctgcggacgctgtataccctcctccacttcccgctgcagccaataaaggccgttcctaccataaaaaaaaaaaaaaaaaaaaaaaaaaaaaaaaa

SEQ ID NO: 17445 - DNA, 471 bp, Homo sapiens
tattttaatttatagggcaaatattcaattggatacgggggaggtttcctttgagtaagccaataaatattgactcagcaatattctgctacactggtgattttgatcttgaaatttcaaagtgtttctatcagttcaccagtccttgctacattttaatttcctttttgctgatatccaggttgggttaaacccattttaagaggagtttgagccaggtgcagtggctcatgcctgtaatcccagcactttaggaggctgaggcaggtggatcacttgaggccaggagtttgagatcagcctgttcaacatggcaaaaccctatctctactaaaaatacaaaaactagctaggcatggtagcgtctgtaatcccagctacttgggaggttgaggcaggagaatctcttgaacgtgggaggcagaggttgcagtgagctgagatcgcaccactgcactccagcctgggtga

SEQ ID NO: 17446 - DNA, 141 bp, Homo sapiens
  misc_feature 75: n=a, g, c or t
cttttcggagggtggtgagctagtctgcggacgctgtataccctcctccacttcccgctgcagccaataaaggcngttcctaccataaaaaaaaaaaaaaaaaaaaaaaaaaaaaaaaaaaaaaaraaaaaaaaaaaaaaa

SEQ ID NO: 17447 - DNA, 148 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaaaaaaaaaaaaaaaaar

SEQ ID NO: 17448 - DNA, 159 bp, Homo sapiens
cttttcggagggtggtgagctagtctgcggacgctgtataccctcctccacttcccgctgcagccaataaaggccgttcctaccataaaaaaaraaaaaaaaaaaaaaaaaaaaaaaaaaaaaaaaaaaaaaaaaaaaaaaaaaaaaaaaaaaaaaaaa

SEQ ID NO: 17449 - DNA, 140 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaaaaaaaaar

SEQ ID NO: 17450 - DNA, 148 bp, Homo sapiens; identical to SEQ ID NO: 17447

SEQ ID NO: 17451 - DNA, 153 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaaaaaaaaaaaaaaaaaaargct

SEQ ID NO: 17452 - DNA, 144 bp, Homo sapiens
cttttcggagggtggtgagctagtctgcggacgctgtataccctcctccacttcccgctgcagccaataaaggccgttcctaccataaaaaaaaaaaaaaaaaawwaaaaaaaaaaaaaaaaaaaaaaaaaaaaaaaaaaaaad

SEQ ID NO: 17453 - DNA, 131 bp, Homo sapiens
ctttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaaaaa

SEQ ID NO: 17454 - DNA, 129 bp, Homo sapiens
cttttcggagggtggtgagctagtctgcggacgctgtataccctcctccacttcccgctgcagccaataaaggccgttcctaccataaaaaaaaaaaaaaaaaaaaaaaaaarraaaaaaaaaaaaaaa

SEQ ID NO: 17455 - DNA, 130 bp, Homo sapiens
cttttcggagggtggtgagctagtctgcggacgctgtataccctcctccacttcccgctgcagccaataaaggccgttcctaccataaaaaaaaaaaaaaaaaaaaaaaaaaaaaaaaaaaaaaaaaaam

SEQ ID NO: 17456 - DNA, 346 bp, Homo sapiens
ataggtctcgtcaagaccagcccatgtttcttaaaaactgcagtattatgaagagttcctgtgccttgccgcgttttaacctttttagaatgcgacatctgttcatctttaaaatatcattttatctcatactgttagtagtagcttcttaactactacccattcttaactttaagaagcatagaatttagaatatagaacgaccgcttgtatggcctggatctgggcacttaaccttactaagtttatctcgtgtaaactgaccttgctaactcacgtgaggcttaaataatacaatgtggaagacttcagggcacatttttggttttttggtttttgtttgttt

SEQ ID NO: 17457 - DNA, 140 bp, Homo sapiens
tatataaaggagctccgcgtgcggaggcctttcggagggtggtgagctagtctgcggacgctgtataccctcctccacttcccgctgcagccaataaaggccgttcctaccataaaaaaaaaaaaaaaaaaaaaaaaaaa

SEQ ID NO: 17458 - DNA, 596 bp, Homo sapiens
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaagcaaatgcaacaaaaacaaagataaataggtgagacttaattaaactaaagagcttttgcatggcaaaaggaatagtcagcagagtaaacagacaacccacagagtgaagaaaatcttcacaatccatacatccgtcaaaggactaatatccagaatctacaaggaacgcaaacaaattagcaagaaaaacaaacaaacaaacaaacagtaccatcaaaaaataggctaaggaaatgaatagacagttcttcctttgcatttgtatttgtctgctctcttgcgtattttgggcagcccttgctgctgactcctactgcttgatccccacactctcccctagacaactttgcagttcatacacgactccctgaaagagaacacagaaaacatttggaagtggtggagtgtgctgtaaagagtgtgagatttctgtcaaaagttctgattgt

SEQ ID NO: 17459 - DNA, 478 bp, Homo sapiens
gtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgactggaacccccagaccagctcaaacgggagccaaaactcgaagcttggaagaattagcaggaaatggcggatgaggcgttgtttttgcttctccataacgagatggtgtctggagtgtacaagtccgcggacagggggaggtggaaaacggacgatgtattactaagctggaaaacatggggtttcgagtgggacaaggattgatagaaaggtgagcaggttggatttgaaaattttcttgcaggtttacaaaagatactgcaagttcaaggatgagttagatatcatgaagttcatttgt

SEQ ID NO: 17460 - DNA, 466 bp, Homo sapiens
agcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgactggaacccccagaccagctcaaacgggagccaaaactcgaagcttggaagaattagcaggaaatggcggatgaggcgttgtttttgcttctccataacgagatggtgtctggagtgtacaagtccgcggacagggggaggtggaaaacggacgatgtattactaagctggaaaacatggggtttcgagtgggacaaggattgatagaaaggtttacaaaagatactgcaaggttcaagggat

SEQ ID NO: 17461 - DNA, 454 bp, Homo sapiens
aacttttgtttcttctgtgtcctccaggtgccagcaccccagatcccaactttctttacattcaaacaggccaagcaagggcttcttaaggacccgatgaaacttccgtggaaccacaatataccgtggttgtttgcacctcagagtttctcatctcggaatccagcgcccacattaattcagggcagcaaagaagctagakaygtgggaggctgtgcggttctgcgcaagtaagttttagagagcagaaacggtagggtcacagtcctttgttttkacctggaggaggaggakgagacctttcataccggcctaggggctcagcattkgaaagccacccagtttcccagactaccagggattttaaatgagtgggtcttgtttttgaatagatwttacaggagagtggtccgtgtggctccctggaagtacagagaaactacctccatgacat

SEQ ID NO: 17462 - DNA, 364 bp, Homo sapiens
tttactacttttggggtgaaaattttaaaaaatacatagtgctgggattacaggtgtgagtcaccatgctcagccagaaaaataaatcatttaaaaatcatgatttgcttctgaattgaatattgttttaagaactttttgatgattccagttgctactgctggtctccagcagtttcttagaatagtcaatggacacaagttatgttaaaatctctattaggccaggtgcagtggcacactcctgtaatcccagcactctggggcaccgaggtgggtggatcacttgagctcaggagtgttctagacaagcctgggcagaatggtgaaaccaccatctctacaaaaaaaaaaaaaaaaaagct

SEQ ID NO: 17463 - DNA, 477 bp, Homo sapiens
aacatctgactctccctccccaaagagagactccagcgagagactggggatttggaggtccaagtcatggcagaactgggttgcttgctaggacacaaggttagcatgcccctgtagcagcaatgtgagaatcagaaaaggtgactgtgcatctcaagaagccgaatcaaaaagccaagccaaccacctaaccagtgattttcaagccctccagaatacccatcatatagcccctgaggtggcatggtgatgtctccatgagggaaccccttcccactcatcctgtcacgtatatcatagtgttcttgactgggccattcatctaagatgggatttaccctgtgaaacaggaagaagacttatggaccccaagcatcatttcgagttgtagttgagtttttaaaagacatacatgcaaagttcctttgccttggaccctctgcattattaaagctgctgtattgctaacccaaaaaa

SEQ ID NO: 17464 - DNA, 874 bp, Homo sapiens
agacagaggcagggcttgcgacggaagtggcctctctgcttctgcagggctggggaagatgctgcgtccascgttaccgtggctgtaccttggcctctgcagcctcctggtgggggaggcagaggccccgagccccgtggatccgctggagcgagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctgggacagttggtaaatgctaaatgaattagaagaaaacatgtactagacattatttttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctgtttgcaaagtggtgtcagctgtggggatcttgggccctcgttcctcacctgcatcctgccctgcactcaggtgctccccctgaagtcagggtcacactcaggtagacctgtt

SEQ ID NO: 17465 - DNA, 424 bp, Homo sapiens
  misc_feature 422: n=a, g, c or t
taacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctatycctttgacactacgcacttttataatacatgttaatgctatatgacaaaatgctctgattcctagtgccaaaggttcaattcagtgtatataactgaacacactcatccatttgtgctttkgtttttttttatggtgcttaaagtaaagagcccatcctttgcaagtcatccatgttgtwacttaggcatttwatctkggctcaaattgttgaagaatggngg

SEQ ID NO: 17466 - DNA, 167 bp, Homo sapiens
ttatcttggctcaaattgttgaagaatggtggcttgtttcatggtttttgtatttgtgtctaatgcacgttttaacattatagacgcaatgcattgtgtagctagttttctggaaaagtcaatcttttaggaattgtttttcagatcttcaataaatgtttttcttt

SEQ ID NO: 17467 - DNA, 205 bp, Homo sapiens
tgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctcctttttttcttctttctttttttttttcatttcaaaattgctgccagtgttttcaatgatgg

SEQ ID NO: 17468 - DNA, 521 bp, Homo sapiens
tatgtacaattatcagaaccaggaaagttcacattgatacaatagcaatgaccaacaataccataatctatagaccttactgaagttttgctaattgttattttggtgtggttgggttttttgtttgtttgagatagggtctcactctgtcacccaggctggagtacagtggcacagtcatagctcacttcaacctcaaactttgggcctcaagcgatcctcccgcctcagcctcccaaaggctatgattacaggcatgagccaccatgctggcctcatttcccctttccttctcaaaaggattctggctttccctactgcattcatccacgtccactacccgctccaagagagctgagtaattgtcaagccaggtttggggagctttcttgatggaggggatggaaggagggtggtgctcaggctacagcagggagagcttttctgtttttgagctaaagacataacagggtgcagaggctgagaaaaggagagttctaagcaacatgtcacgagctatg

SEQ ID NO: 17469 - DNA, 356 bp, Homo sapiens
aggcccgggagccgggaggtgcgggcggcgkcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcaacgmrargaccatgaccacatcccacctgaagcagtgcatcgagctggagcagcagtttgacttcttgaaggacctggtggcatctgttcccgacatgcaggggggacgggga

SEQ ID NO: 17470 - DNA, 365 bp, Homo sapiens
  misc_feature 225: n=a, g, c or t
tttctccggggatgcccctkcctcccccagcacccccttaggacggtggcgacggggtctgaactctgctcccccacccgcagcgcgatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaasvangaccatgaccacatcccacctgaagcagtgcatcgagctggagcagcagtttgacttcttgaaggacctggtggcatctgttcccgacatgcagggggacggggaagacaaccacatggatggggacaagggcgcccgca

SEQ ID NO: 17471 - DNA, 550 bp, Homo sapiens
caatctgtggaatgatattttgacactgtgacaatcctttttcccgacagtctttcacatagttgttttagtattcactgattcttacctgaatcagtaatagtatactatagtgattgtaaaaatggtgattttctatttctgtaatcccttatgtatttattatttggctttcttctctaaagaagatgtttctcttcctcctgcctccacacttactttcagatcagtgtggacttgttctgtttttaattcatatattaactcataattttatcctttatagtggtctggccgggcgcagtggctcacgcttgtaatcccagcactttgggaggccaaggcgggtagattatgaggtcaggagttcaagaccagcctggccaatatggtgaaaccccatctgtactaaaaatacaaaaattagcccagcgtggtggtacacacctgtagtgccgagagsagaaggttgcagtgagctgagatagtgccactgcactccagcctgggcaacagagccaagactctgtcccaaaaaaaaaaaaaaatg

SEQ ID NO: 17472 - DNA, 113 bp, Homo sapiens
aatacactgctgatgttcaaactgtgtccaagtaagacaaacgctgagctgagctgtaaccaatccagctatttctgtgccttactgctgatttctatcgtcactttactttt

SEQ ID NO: 17473 - DNA, 246 bp, Homo sapiens
ccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaacctaaaaaaaaaaaaaaaaaag

SEQ ID NO: 17474 - DNA, 440 bp, Homo sapiens
gtcacagtggaggttctagcagactaaccaggagatgcttcagaaggtcgaagttgagtatgaaacgctgcctgggtggaaascagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagc

SEQ ID NO: 17475 - DNA, 460 bp, Homo sapiens
  misc_feature 445: n=a, g, c or t
aagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgtaasaacccatgctgccatccccactgggaccgtccctgactcccgacacctgcagaggctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccangaggtgggaggacct

SEQ ID NO: 17476 - DNA, 318 bp, Homo sapiens
taaattttaaaagatcccgtgttttatgaaagtaaagaaataggttaacagtccccgtgacaagaatggaaaacattctcaggacctataccacacatatacatttaaagtatcactcagcctgggcaacatggtgagggcctgtctctacaaaaatttaaatcttagccaggcatggcggcacgtgcctgttgtcccaggttgaggcgggaggatcgcttgagcccaggaggtcaaggctgcagtgagctatgattgcgccactgcagtccagcctcggtgacagagtgagactctgtctcaaaaaaaaaaaaaaaa

SEQ ID NO: 17477 - DNA, 67 bp, Homo sapiens
ttgtcgtcagtcccttccatgcgtccatacctctggtggaagaagtacatcactcaggggcagctgc

SEQ ID NO: 17478 - DNA, 55 bp, Homo sapiens
  misc_feature 6,39: n=a, g, c or t
ttgtcngtcagtcccttccatgcgtccatacctctggtnggaagargtacatcac

SEQ ID NO: 17479 - DNA, 536 bp, Homo sapiens
agacgagggatgttattttgggcagtgcatctggacttggttcaagtggcaccagccaaatccctgccttactgacctctcccctggaggagcaggagcagtgctcaaggccgccctgggagggctgagaggcaggctctggactggggacacagggatagctgagccccagctgggggtggaagctgagccagggacagtcacagaggaacaagatcaagatgcgctttaactgagaagcccccaaggcagaggctgagaatcagaagacatttcagcagacatctacaaatctgaaggacaaaacatggttcaagcatctgggcacaggcgaacatacatatgatagttgagaaagacacatattctgatcatgaagaaataaacacaagttaaatatgactaagcagaaagatggaaggaccaggaatggtgatgctaacttggaaccacgatgcaggtctaaactcctctacaatcatcctcccttgtgagaaaaatacaacatacatatgatagttgagaagacacatatt

SEQ ID NO: 17480 - DNA, 476 bp, Homo sapiens
agagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgggaagcccccaaggcggaggctgagaatcagagacatttcagcagagtcctggacagtcgcagcttaagttagcagcaagaggacttgaggttaaaggtatagcacgcaaatatgaggctggagccactgagtagaggctgagggcatctccacagtccaaagccgggctgcagacacggaagcatctacaaatctgaaagacaaaacatggttcaagcatccgggcacaggcggtccacccgt

SEQ ID NO: 17481 - DNA, 523 bp, Homo sapiens
aattattaaagggcgacgcgcgcaacgcacgttacacgcatcgcggagggagcggaggtggttgggtttctgagtttgagtctgtcgctcctggctctcccgacacaacagcggcgcccacctgcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgygggtgctggtcaagctgggtcacccggcactgagtgacgatcagcaaatactcagtggacgaaatatttgcagtgcagtgaggtgaggggcataaccgcggastattttcgaagagatgagagagactggggattaggccaggcttgaagggaagaatggtttgagcaccgaggacaagaattaattccccaggcctgggttccagccttgtgcggctatcacgtgcttgaaacctggctatt

SEQ ID NO: 17482 - DNA, 466 bp, Homo sapiens
  misc_feature 426,434: n=a, g, c or t
aattattaaagggcgrcgcgcgcaacgcacgttacacgcatcgcggagggagcggaggtggttgggtttctgagtttgagtctgtcgctcctggctctcccgacacaacagcggcgcccacctgcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgygggtgctggtcaagctgggtcacccggcactgagtgacgatcagcaaatactcagtggacgaaatatttgcagtgcagtgaggtgaggggcataaccgcggastatttcgaagagatgagagagactggggattaggccaggcttnaagggaanaatggtttgagcaatcgataccgtcgacctcg

SEQ ID NO: 17483 - DNA, 300 bp, Homo sapiens
  misc_feature 13: n=a, g, c or t
acacgcatcgcgnagggagcggaggtggttgggtttctgattccgatttctcttgagcgcgtttcggagccggcccagaacagagggaagccagacacaccatacccggcccaacagtggcagggcggctgcgggtgctggtcaagctgggtcacccggcactgagtgacgatcagcaaatactcagtggacgaaatatttgcagtgcagtgaggtgaggggcataaccgcggagtawttcgaagagatgagagagactggggattaggccaggcttgaagggaagaatggtttgaccac

SEQ ID NO: 17484 - DNA, 491 bp, Homo sapiens
taagttagcattctttaagaatacttgctcagtagtattcagagtatttactatctcaccttgaaaataaaacctcagttaaaatactataattagccaggtgcggtggctcatgccaataatcccagaactttgggaggctgaggcaggtggatcacttgaggccgggagtttaacaccagcctgggcaacatggcaggaccccatctgtactaaaaatacaaaaacttagccgggcatggtggcgcatgctggaatcccagctactcaggtggctgaggcatgagaattgcttgagcctgggaggcagaagttccagtgagctgagatcacaccactgcactccagcctgggtggcagagtgagactctgtctcaaaraaaacaaacaaacaaaaaaaactactatagataaaaatattggaaaataaggcggggtgtgctggcttatgcctgtaatccgagcactttgggaggctaaggtgggtggac

SEQ ID NO: 17485 - DNA, 470 bp, Homo sapiens
gctatgtgaagagatccttatgaaatacctcagaacccagcactcaagtgatgtggaccttctgcctgcatgctgctctcatgttccactgtgacatattcctagggcagcatctaggtgatattactctccacatctgcctgagccctgactacttgggacaccttgcaatatctctgagcccttgacctaagtgatgtggctcttttgttgcctgggccttcacgataggtggattttggcatattgctaagcccagcactcaaaacatgtaactctcctatttttcctgaattatacccacaaagaaaattttgacctactgaatggctcaacaccaaggttattatgatggttgtaatgaagatcatattagtataacggagctctatgtttctgaatactgaacaactatttataaaattttatcctactttttctctattaaaggtatgactgctctstctgat

SEQ ID NO: 17486 - DNA, 490 bp, Homo sapiens
gctatgtgaagagatccttatgaaatacctcagaacccagcactcaagtgatgtggaccttctgcctgcatgctgctctcatgttccactgtgacatattcctagggcagcatctaggtgatattactctccacatctgcctgagccctgactacttgggacaccttgcaatatctctgagcccttgacctaagtgatgtggctcttttgttgcctgggccttcacgataggtggattttggcatattgctaagcccagcactcaaaacatgtaactctcctatttttcctgaattatacccacaaagaaaattttgacctactgaatggctcaacaccaaggttattatgatggttgtaatgaagatcatattagtataacggagctctatgtttctgaatactgaacaactatttataaaattttatcctactttttctctattaaaggtatgactgctctgctctgataaacgaaaaaaaaaaaaaa

SEQ ID NO: 17487 - DNA, 415 bp, Homo sapiens
ctaagaattgggcaccaacaaatttgcactctaagaaatgttaaaggaggttcttcaggctagaagaaaataataccagatagaaacgttaaatgtccgctttaaaaacgaggagcatggccgggcacggtggcttacacctctaatcccagcactttgggaggctgaggcaggcagatcacctgaggtggggagtttgagactagcctgaccaacatggagaaaccccgtctctactaaaaatacaaaaaattagctgagagtggtggcgcatgctgtggtcccagctactctggaggctgaggcaggagaatcgcttgaacctgggaggtggaggttgtggtgagctgaggtcacgccactgcactccagcctgggcaacaagagtgaaactctgtcaaaaaaaaaaaaaaaa

SEQ ID NO: 17488 - DNA, 612 bp, Homo sapiens
aaaaagacgaaggggagcgcccaaggatgaggaacgttccaagacactgagtgatttgctgaaaatcacacatctagatgcaaagccagaatgtgagcagtgaccaccacacttgacaaatccgttgttgcacacatttgtactcttcaatcaacaaaacctgatgcaaaaaacagaaaagggggagatgtacatgcattttccctcactgcaaaaaaaacacaacttgtttaactacaggtgtgttcctggtggtctttgaatgaagacattgacagaaagtaacatagcatgctggttaaagactgtttttattcgaatcctggctttgcaatcaacagctgcataaattaaactctcgacctcagctcccttatttgtaaaacaagaataacaaaaagacatttttataaggttgggttgaaggttaaatgaaataacagaagattatctcttcactaattttagctgtagaaaacagaagccaatcgaaagagctcccagtccaaagctggaacaacttgaacaacaaaataaataatgtagcattggattacaaaccaaccataaaacaaatatccatgagtctatattgatgtcaataaatgaata

SEQ ID NO: 17489 - DNA, 432 bp, Homo sapiens
attatcgcagtattactgcaattatacagataccacaatttcagatattgatcagcgtgttcagttggtttctaaggaggtttacttacctcatggtacacctagtttgcatagtttgattatatttaactcttatgctaattgkgggaagtcattgatttattggacagatgcacctgtggtcttccctgagcacatcctggccaaggatgctgcccccaggagatttgagaagtcctgtaagatcatatcagtattttcaaatacttataaaaagccagagggattgacccagaattaccaatataagcttgaccctgagataacaatgccattttatgtttgcatgcataaaaccaatgcaagaggctgatgactccagatcccttatataagccaataaaaagtagtttcattttttatttcatttaa

SEQ ID NO: 17490 - DNA, 317 bp, Homo sapiens
agggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggcttcagcaggagccctggactcatcatcaataaacactgttacagctaaaaaaaaaaaaaaaaaag

SEQ ID NO: 17491 - DNA, 362 bp, Homo sapiens
agtgagcgactaacgctagaaacagtgatgttctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgsctycaccacccaggggcagcagctgtcggaggaggagctggagcggctggaggaggcctgcgacatggcgctggagctga

SEQ ID NO: 17492 - DNA, 379 bp, Homo sapiens
tttatgttgggtggatgaatttatgagggaatttttaacatgtgtgtatgtcttcaatctggtgacatctgatgtctccccaagtggttttttgaagtttttgagaattatttcgtaaatgacaatttcatgaaagattaaacactcaatttatgaaataaaatgaaatgtcttaaatctgtttttaaaaggcaatagtttttaactgttgtaagtggttgattttaactgaatatatggatttttcaacagaacaagacttaaagctgacatcagaggaagagtcacaaaggcttaaaggaagtgaaaatagccagccagaggcatggaaactcttaaatttaaacttttggtttaacgttttttttttttttttttt

SEQ ID NO: 17493 - DNA, 382 bp, Homo sapiens
  misc_feature 265..266: n=a, g, c or t
aataatatttgtgcttttaatctttttactgtagtacagctttatattctgtcctttaaaagtccttctactggctggtctgargggtagtgagttatctcagttgatcattcacagccagttacagattgaactccttgttctctactctttcccccttttcactactgtacttggctagtcttaaatttttttcttaataataaatacatttttgaaaagtctttttacttactctttatatttagtgtttaatgcactabmnnttgactattactgtttatctatatagcatcaaatagtaaatatagatcttatgctggaaatgtcaacctccctggcagctgtaacgcccatcattgaaagggaaagcggaggacac

SEQ ID NO: 17494 - DNA, 467 bp, Homo sapiens
acatgttgtgaatttggttggagtaaagatctaagggtccatactgggctataaaaatagtgtagtacttgagcagtactgtaaaaatggcaattataaataattatgagtgttgaggaggtaatatgaacactcaagttcaaagcagtaaaataaaaattaaaaaaaaaagacagacttaggtaagccatctatcaactcggagaatgctgatgctttgttgaaagagagctttgtcttacaaattaggcacttataaaaactcatcactcactgcagatgttactttaagacattctggagcagcgtcatgtgcaggaacaataaggaagtgagtgcttttgtaattcctgaacaactgtgtcttacacttactaagggattcatgggcaatatgactgaataggaacagctccagtctgaagctcccagtgagaccaacatagaaggcaatctgggtgttatga

SEQ ID NO: 17495 - DNA, 407 bp, Homo sapiens
agctggttttgaggaagtgagctgccatgtactaggccacgtggcaagggcctggttggggacctccaggggttgagagcatcctctggacaacatggaaaaagraratgaaaatggtgacctcagccctatagctagdrggaattgaatcctgtcaacaacgatactcatcactcactgcagatgttactttaagacattctggagcagcgtcatgtgcaggcagaaaatagtatcatctcagccttctatgaaatcaaggcaatattcatgtgaaagtatattccaaacccagaacctgagcacagattgggactgagaaacacttgtctagattgtcaggcaatctgtaacatcagcagtggatggaaagaaggagaaagawgagttttatggactctaaccca

SEQ ID NO: 17496 - DNA, 483 bp, Homo sapiens
ttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaattt

SEQ ID NO: 17497 - DNA, 281 bp, Homo sapiens
aaggacacgggtcgctggcgggttaggtggctgcgtggccgcctcacttcgcgcacgsccgctagstggggggagttgatttgcactgctccgggtgtcggctccggcgggacgggcggttctgcgtacccctctccagtgtcacctggggctgaatcttcaacctgtcaaagccttcttaattatgtctgagaaaaggatcctgattgagtcaatgctttgcattctcagtcctctgcataaagctgagagatgcctacagctgagagtgaagcaaaagt

SEQ ID NO: 17498 - DNA, 521 bp, Homo sapiens
tgcccacctccccagtgagtgaccaatgtctcattgttaatgcatctgatgcacagagtttagtggtctgagggaggtcagtcgccaagcggagattgaaatcacatttgtatttacattattacttttctacagtttggtttgttgcaggctttcacactactaatctgggctgaatccttgaattactttgtctaccaagggtttcaaagaacttgataaacttgttctaattagccaacatattcatccatgttgtccgtataccaggtgtaaaaataaaacgtttcttaatgcacacaggacatggaaggcaatctacacattttcaggtgtagactttgcttgtgactcttttgtgaggaatagtcattgttactttaggaaaaccctgagtttatccaactcttgttagaattggataagtgtaaaaacctacaatagaatgcaagtgtgagagccaattcctctggtwaaataaactcatattattattcaaaaaaaaaaaaaaaaargcttta

SEQ ID NO: 17499 - DNA, 403 bp, Homo sapiens
  misc_feature 93: n=a, g, c or t
ggcacagagccgcagcttgctttcaggacacgggtcgctggcgggttaggtggctgcgtggccgcctcacttcgcgcacssccgctaggtggngggagttgatttgcactgctccgggtgtcggctccggcgggacgggcggttctgcgtacccctctcctggcagatacataactataagagagcattggcttggtcctccaaagctagcagtttggtgggagttacagaacattttaccagggtgaaaattcaaggttgaggtagagggagctacaaagattaaggcaccctggaagcacagaagagaagttcttaaatgcccttcaaggatctgattgagtcaatgctttgcattctcagtctctgcataaagctgagagatgcctacagctgagagtga

SEQ ID NO: 17500 - DNA, 92 bp, Homo sapiens
aatcagttcccaagttctaggcggaagaggcccaagagacaccactttctcgctttcagacgtgtctacataagaccacaaaagaaaccgag

SEQ ID NO: 17501 - DNA, 103 bp, Homo sapiens
aatcagttcccaagttctaggcggaagaggcccaagagacaccactttctcgctttcagacgtgtctacataagaccacaaaagaaaccgaggcaaaaacaaa

SEQ ID NO: 17502 - DNA, 137 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaaaaaaaaaaa

SEQ ID NO: 17503 - DNA, 126 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaar

SEQ ID NO: 17504 - DNA, 492 bp, Homo sapiens
tgaaaatagacctttgaactaacattttcataataaaatgtctttcactttgacttttaaatggcagtgtatattatttctaaactaaaagtttaatattttcccatgtggcactttaaggtcttattatctatcttttggtaggtagctatgtggattcattttctgcataggmagaatcctaagtctaggtaagagtcagataaatttagaagctggctgacattcttagtaagctgccttgtatttttcaaacttgtcccatactcttctgagattaagaaaagttgcatacatccaatttgtttcaggcagaacttgagatgaggataaaaggggattgaatggttacttcccaccattcctgactaggcacaccctcctccatgtagaactgtctctaactttgagctttgagagaagaggtaggcaagtgagcagtgtttctcaattttacatattccggaataggaggaatggattaaagtcacc

SEQ ID NO: 17505 - DNA, 63 bp, Homo sapiens
ttgtgacaagatcttcccagctacagagaagcagatctttgaagaccacgtgttctgccactc

SEQ ID NO: 17506 - DNA, 92 bp, Homo sapiens
ggaagttgtgctcttggtgaagggggttcttccttttttatttaccggtggctgtgcttccaatttaggaagaccccggcgacctgttcctc

SEQ ID NO: 17507 - DNA, 530 bp, Homo sapiens
atttgtcttgacggatagtaaaaagaacaaacttgttttatacaaaatcagatgctccaaatggtcagttgatgatgataccaatcaaagaaaactaaggaggaagaaaaagaaaacaggaaagagaggaggcaacaggaaaatcggccttcktccttcagtctacgcttgaaattgccagggatggataaatctgaagatgaatgaaaaaaagaaactactgggaacggaacagaaacaaaaaaaaggatgggaaatctgaagctgctatttcttattctgatcttaatagcaggatacagttgaataataacattatctattggagatcactgaaatgtagggagggaattccattttgaaaactttaatatgtagagagtcagtacatcattttcacaagcaatatccttagaagaaaggattttttttagaactatcatgctacagaaaactgcatttttatagtaactgaaagatgcaaagttactgaaaaaataaaactgccattttattgtaaaaaaaaaaaa

SEQ ID NO: 17508 - DNA, 446 bp, Homo sapiens
gtcggaaggtggcgagcctgaggcgaacaatggcggastgggcgaasgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgtccaaaaaaaaaaaaaaaaaagct

SEQ ID NO: 17509 - DNA, 514 bp, Homo sapiens
ccacagatacacacacatttaccacacttggctcttatagactggaaggacagatgctcttcctgagcaaaggggccgacctgcagaaagcttccctctcaaagctgattgacaccacccaagctcctctcctaggccttccccactgagggctttggggctgcagggccctgtccacgagacaaagtctcactctgctgtccaggctggagtgcagtggcgcgatctcggctcactgcaacctctgcctcccaggttcaagcgattctcctgcctcagcctctcaagtagctgggactacagtatcctgcataaaactgcattaaaaaccagtaacatcagacccgggatggggacggaaggtccaaatcagaacctccatggaatgcatctctacatattttcacatctgttttcaagcaaggagcaagagcagcaagaaagtgaggacttcctctgatgcacaaacctgggatgtgctgtgcaaatcagctacctgggcttcccacctgtg

SEQ ID NO: 17510 - DNA, 120 bp, Homo sapiens
aacacacacatttaccacacttggctcttatagactggaaggacagatgctcttcctgagcaaaggggccgacctgcagaaaggtaacaaagcaccacattagatactgaagatagaaat

SEQ ID NO: 17511 - DNA, 522 bp, Homo sapiens
  misc_feature 459: n=a, g, c or t
agagaagccagctacacctacattagaaagagtggaacagatcacgggtcacaggattaaggctagatggggtttgagatgtgggaagacttgaggtcattttgagttttgagaaaaggagagacatgaagaggcagaaaacatgtttactggacccagctactttgcagtgattagtgggaccttcagaacataaatagatcctaaggagtgaatgcttgtaccccttccaaaatttatatgctgaagcctttatatggttgtatgtaaagacagacccactaatgaagtaattaaggttaaatggagtcataagagagaggccctaattccataagattagtgtccttataagaagagactccagagaactcactttctcactctctccctccctttccttgcatacaaaccaagggaaaatcatatgagaacatagcaagaaggtagctgtctganagccaggaagagaggcctcagcaggaaatgaatcagcaagaaccttgatcttggacttctagc

SEQ ID NO: 17512 - DNA, 546 bp, Homo sapiens
acttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgamcagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatg

SEQ ID NO: 17513 - DNA, 483 bp, Homo sapiens
aatttcttaaatcatggtctgtcactgaatctggttataaaaccttatcttgcactagaaggatctgtagcttttccagctgagaatggggttcaggataccgaatcaacacaagaaaagagagaaactggggatgaagaaaactcagctaaatttcctgtaggaaggagagattttgacatattctcagaccacttctaccaaaacataaatctgtgattgtgatctctgaaagtcagtccttttatctactcaataccttgcacagtaccttgaactttgtaaatacttcaaaaataaaacttgcttcaaatttcatctaatttaatacagaggcattatcctttgaaagcgataggtggctctggcctcccgctcctcttggatccatcagtactagccttaagctattgtgccctctcaaagactcaagccacatccaagcaatactccttccagagatggctgattactaactctgca

SEQ ID NO: 17514 - DNA, 415 bp, Homo sapiens
attgcctcgctgctttcttttcttcaagacgggctgaggattgtacagctctaggcggagttggggctcttcggatcgcttagattctcctctttgctgcatttccccccacgtcctcgttctcccgcgtctgcctgcggacccggagaagggagaatggagagggggctgcgctcctctgcgccgtgctcgssytcgtcctcgccccggccggcgcttttcgcaacgataaatgtggcgatactataaaaattgaaagccccgggtaccttacaactcctggttatcctcattcttatcacccaagtgaaaaatgcgaatggctgataaggctccggacccataccagagaattatgatcaacttcaaccctcamttcgatttggaggacagagactgcaagtatgactacgtg

SEQ ID NO: 17515 - DNA, 490 bp, Homo sapiens
ttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggag

SEQ ID NO: 17516 - DNA, 444 bp, Homo sapiens
  misc_feature 115..117: n=a, g, c or t
aaaaaacagcagacgctgagccctggcctggccgcccgttctcctcgttctagccatctcttagggacggggctgcagcataggagtctcagctgcttacatccaggtccaggannntgtctgctaacagacgctggtgggtaccacctgacgacgaagactgtgtgtctgagaagctcctgaggaagactcgggaatctccactggtgcctataggcttaggaggctgcttggtggtascagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaa

SEQ ID NO: 17517 - DNA, 492 bp, Homo sapiens
ctaaagagttgtaatgtacaatcaggagaagatacatactatgcttaagtatggtatattcttratagcatgggtagttgagggagagatagtaaaaataaaatgaccagctaaaacttagatcttatttatgtacatatttaaatacacatttcacaaagcatataaatttcaaaatggaggtgaagatgaggagatattaatgacaatataaatagttggtgtgggaagcctgattaaaattaaccagaaaatcaaaaggtattaagactagaagggctgtcatttgaagacaagaaggagctattttgaaaatgtagggtcagctgggtgcagtggctcacacctgtaatcccagcactttgtggggccgaggcaggcggatcacttgagatgaggagttcgagaccagcttggcgaacatggcaaagcccatctctactaaaaatttaaaaattagctgggcacagctgggcaacagagcaagactcc

SEQ ID NO: 17518 - DNA, 578 bp, Homo sapiens
tcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtat

SEQ ID NO: 17519 - DNA, 512 bp, Homo sapiens
  misc_feature 59..60: n=a, g, c or t
gtgctttcgcttcatcctagaggctaaatgggctcccctggactcgcctggcagaactnnccacctagaagaacgttattgtaagggggaaatgcaaacagggtgaagacaagaggcataggtgatggacactaaaacaaagaccctgtggaccccaaagtcatttccattgccaaccgagtagctgaaattgtttattcctggccaccaccacaagcgacccaggcaggaggcttcaagtccaaagagatttttgactgagggtctctccttccagctccaaggccacgtgcctgtagcttcaagttctaagaaagatgaagaagaacaaatactaaccaaaattgttgagctgctgaaatattcaggagatcagttggaaagaaaggaaaaagaatgggaggagtcagcaaagaccaagataaaaatggcacttctctggaggagcattggtggtggacccagagttctgagtatacctgaggcatttatgaagaacagcttcactctca

SEQ ID NO: 17520 - DNA, 394 bp, Homo sapiens
cccacccaggctcggagcgcgaggtccccaggtgggccccaaccgccggatcctgcccttctgcactggggcccagccgcctcccggcctttcctccctcccccaggagatgagacgtatcttgacatcttccgcgacttctccctcatggcgtcagacgacccggagaagctgagccgtcgcagtcatgacctccacacgctgtgacccgaggcccacggggccgcgcctgcctcccttccccgccaccgggccctctgccattaaagcctccgtgcttctggcggccccttgatagttcacaagagaagtcgtttcattcaagttggtgtaatcagctggggagtagaggatgtctgcaaaaaccagaagcggcaaaagcaggtacctgstc

SEQ ID NO: 17521 - DNA, 567 bp, Homo sapiens
gactattatgatctgtaccccaccccgacgcacgccaagcggctttttccccatttgtggccaaatttcccggcatggggaaggagccttaggggaagcacccgggacctccttggcttcttctgggagtctagtttcacctatttcgtttcgccaacaggsagacgggcaagacttcgggctcagctgccaccatcagtactgacctgtccatggctaaagccttttccacacacaaccaaagttggctgcagtttagctaccgcgttttagccttcccgctctccggaagcaagcccttcgacccggaagcagtctgtccctaaaacagacccacagaaaaggggtaggggagaagaaacaacgttcccatctagcgcatgcgcgacttcagcctacaggtgcacgcccggtgggcwaggcgcaaaagtttgccaatgtgttcctggttgcgtttasccagacgccctgcggccgctttgcctgaccaaagtctgtgggcgtggaacaggccctgggttctcctactgggaagaatgaagttcaggtactccatgtgatatatgg

SEQ ID NO: 17522 - DNA, 561 bp, Homo sapiens
gactattatgatctgtaccccaccccgacgcacgccaagcggctttttccccatttgtggccaaatttcccggcatggggaaggagccttaggggaagcacccgggacctccttggcttcttctgggagtctagtttcacctatttcgtttcgccaacaggsagacgggcaagacttcgggctcagctgccaccatcagtactgacctgtccatggctaaagccttttccacacacaaccaaagttggctgcagtttagctaccgcgttttagccttcccgctctccggaagcaagcccttcgacccggaagcagtctgtccctaaaacagacccacagaaaaggggtaggggagaagaaacaacgttcccatctagcgcatgcgcgacttcagcctacaggtgcacgcccggtgggscaggcgcaaaagtttgccaatgtgttcctggttgcgtttagcccagacgccctgcggccgctttgcctgaccaaagtctgtgggcgtggaacaggccctgggttctcctactgggaagaatgaagtatgttgatagtctggaa

SEQ ID NO: 17523 - DNA, 415 bp, Homo sapiens
ctctagtcatcgccctcgcagcggcggccaacatcaccgccactgccacccctcccagactgtggacgggaggatggagtcgatggccgtcgctaccgacgggggagagkccgggggtcccagcggctcaggtctgtcggcttcccagcgtcgggcggastgcgtcggagaaagctgctcatgaactcggaacagcgcatcaaccggatcatgggctttcacaggcccgggagcggcgcgtaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggcccaactgggagacaaattggactc

SEQ ID NO: 17524 - DNA, 458 bp, Homo sapiens
  misc_feature 241: n=a, g, c or t
ctctagtcatcgccctcgcagcggcggccaacatcaccgccactgccacccctcccagactgtggacgggaggatggagtcgatggccgtcgctaccgacgggggagaggccgggggtcccagcggctcaggtctgtcggcttcccagcgtcgggcggastgcgtcggagaaagctgctcatgaactcggaacagcgcatcaaccggatcatgggctttcacaggcccgggagcggcgcgntccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtggtctactttttcacttttatcttt

SEQ ID NO: 17525 - DNA, 580 bp, Homo sapiens
aaaaaaatttagatttccgtctgtttgtttattcagggatctaaactagagtgcaggaacaatgaggaattccactgttaccacacatctaagccatgttctccatgctgttaccttctcatactcatagtttgatctctttctgcctagctctcatgtctgtctctggattgtttcaaatcctaagagaaaaggaatatcatttattgcctcttgcaaagtaaatactcctctatttaactgacgggatgaaccaatgatgtcatttaacagtttgtttgttggtgatctctactgctgaaatctcattaacatacacatttactcctttgatcttcacgataatcccatggaattggcaagtaaaaggcattattgacattttacagctttttcaggagttaagctgccttcgcaatgaggatcaaacctgcagcttacagcttatagactcgatgtatgtaagcaaaatggggaattgccaagtctaccttaaaatggccatttgccatacagttacttgatagacccattaaattccagtaaattcaaaatgttccaatgtggctaattattccag

SEQ ID NO: 17526 - DNA, 514 bp, Homo sapiens
atctaagccatgttctccatgctgttaccttctyatactcatagtttgatctctttctgcctagctctcatgtctgtctctggattgtttcaaatcgtaagagaaaaggaatatcatttattgcctcttgcaaagtaaatactcctctatttaactgacgggatgaaccaatgatgtcatttaacagtttgtttgttggtgatctctactgctgaaatctcattaacatacacatttactcctttgatcttcacgataatcccatggaattggcaagtaaaaggcattattgacattttacagactgtgaacaagatgccacccccaaatgatgtagtcaatggtgctaccaaaatctactgcaaataacctaataattgtacacagacatcttgacataggccagttctcaacaacagtaaaattttgagcctggagtatgagagctgtagaaaggacagcagaaaagaagcattgaaaataaataaaaactggtcaggggaaatttgacagt

SEQ ID NO: 17527 - DNA, 487 bp, Homo sapiens
atctaagccatgttctccatgctgttaccttctcatactcatagtttgatctctttctgcctagctctcatgtctgtctctggattgtttcaaatcctaagagaaaaggaatatcatttattgcctcttgcaaagtaaatactcctctatttaactgacgggatgaaccaatgatgtcatttaacagtttgtttgttggtgatctctactgctgaaatctcattaacatacacatttactcctttgatcttcacgataatcccatggaattggcaagtaaaaggcattattgacattttacaggaattccttctgtcctgttaagcagtccttcgctttctgcttttggatacttaagtgaccacctcacttttttgtgatgcagcttgttcaatttttggatagttctcgtggacacatggaaatgctgagtagaactatgatacaaatcagctcaccataaagtacaatctccagtggccagaga

SEQ ID NO: 17528 - DNA, 209 bp, Homo sapiens
  misc_feature 174: n=a, g, c or t
gactggatgcatccgctagtactgatttacgaagagaatgatcatgaagggcaaatggcagtgaagcaagaagagctggcttcaggctcagaagagaatgctgtgcctctttttcgcatttttttttttttttwttgatcacatcaaacattttcattgagaaattgacacggncactaatgaggtttatcatggatggtctcagaagc

SEQ ID NO: 17529 - DNA, 381 bp, Homo sapiens
  misc_feature 136,170,172: n=a, g, c or t
acaagaccgttgaggctgccaggcgagtcaggcctttctggacctcgcctgactcggctgggctgtgctgaaattgacccagctctatcagggattatgaaaaaacaaggagtaagcccgaagccgctgcaatctncccrccccagccagtctaagcggcggtgcgggcntncccccttsccccccgcctccgccccggagccggagtagaggaggtggaaaagtcggccctaggcggcgggaggtccttccggcggaggatccgaaatgtggaaaatcgaaaaggcttggagctaaaggtggtggscaagacccttcttstcggccccttcctgttggtssgtaattccctggcgsatccggraagaggtgcacgaactg

SEQ ID NO: 17530 - DNA, 425 bp, Homo sapiens
acatctgcattccgatagaaagggaaacagcagaaacacaatacccatctgagagctacgcttagagaggactctgggcttttatttatttttttacttcagtcttgtgaccagtaattttaagggaaagccaataataatgtttttaaaaagcctcacgccacccctggcggcatctcctcggtgtactttgctgttcagatccgcctgccttctgtgccagcctaacagcgcccggcctcagcccccattgtccctggagctggcgaggtgtccggttgcggascggcggcgtcctctggaaatgcatcctgcatccccgcatggataacagctgcagctatgtcagaattgcacaaagaggggagagtgtcattgtgtgccttttgacacatacattaagaccaaaaaaaaaaaaaaaaaag

SEQ ID NO: 17531 - DNA, 449 bp, Homo sapiens
  misc_feature 396: n=a, g, c or t
agccccaagggggattttgtgggaccgctgcccacagatccaggtgttggaagggcagcgggtaaggttcccaagccagccccaacacccttcccacttggcacccagaggggctgtgggtggaggcctgactccaggctctcctgcccacaccctctggactgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggcgngcactgccagtgtcttccagagccacacccagggaccacgggaggatcctgac

SEQ ID NO: 17532 - DNA, 236 bp, Homo sapiens
acagagtgtgtgtgggaacaarsggccttctcagtgttcatagggaagcccggttcacccatgggtgggccgcaatttgggtgccacagtgagcccctagagaccagctctcccagcttccaggacagggactaggggaggcaagagaggctcttccttaaattgtgcacccaaggtsctcagctgccttactctagactggccccgttaactccccaaaaaaaaaaaaaaaaaag

SEQ ID NO: 17533 - DNA, 517 bp, Homo sapiens
tatacagacagggtctcgttatgttgacaaggctggtcttgaattcctggcctcaagtaatcctcccacttcagcctcccaatatgctgggattacaggcatgaggcgccaagcctggcactggttttgtttttgttcttgtttgtatccctcaatggacatgtgtatcacagaaatagaacttgataaatacttgttaaataatgaactaaattaatgttttaattatggaatattattctaaagatgtttaggaaaagaataagtggtcagttttagtaactttgtaagttaaatttttgttacattgctgtcatacctgtttcaatatttgatattcttaattgcagagttgaagtaagcagtaaaattcagtatcgtaaagaacaacagcaacaacaaatgtggaattcagccaggactcccaatcttgtaaaacattctccatctgaagataagatgtccccagcatctcbaatagatgatatcgaaagaggtaaaatctaagtatatgtaa

SEQ ID NO: 17534 - DNA, 485 bp, Homo sapiens
aattatcctgcctcagcctcccaagtagctgggactacaggctcacgctgccacgcccggctaatttcttctgtattttagtagggacggggtttcaccctgttgcccaggcttgtctcgaactcctgaactcaggcaatccttccgccttggcctcccaaagtactgggattacaggcgtgacactgcgccccgccatttttaaagtacagactctgattcagtaggtctggggtgggacctgaaatttacatttctaacaacctcttagaagatcctgatgctgcagggctgatgtttatattgagcatgacaaaatttaaagggaacatttgggaaacaccccacagtatatatcactgttgatgtttatttaaagggaatatttaaaaaaaaatctgctttcttaggaaaactgtagtaaaaggaatcccatgaagttacaaaarggaaatgattagctgcagataaatgatcattgaaat

SEQ ID NO: 17535 - DNA, 243 bp, Homo sapiens
agaatgtcgtactctcaggaggctccaccatgttcagggatttcggacgccgactgcagagggatttgaagagagtggtggatgctaggctgaggctcagcgaggagctcagcgcgggaggatcaagccgaagcctgtggaggtccaggtggtcacgcatcacatgcagcgctacgccgtgtggttcggaggctccatgctggcctcgactcccgagtttctttcaggtctgccacaccaaga

SEQ ID NO: 17536 - DNA, 352 bp, Homo sapiens
  misc_feature 289,338: n=a, g, c or t
cccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagctttttttttttttttttwaawttggyttnggcacagtagctaaagtgcaagastgawttaatgagaagatatattarntgtagtmatagggg

SEQ ID NO: 17537 - DNA, 589 bp, Homo sapiens
tacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcacagtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcacgcctataatcccagcaccttggaaggccaatgagagtggatcagttgaggccaggagtttgagaccagcctggccaacatggtgaaatgccgtctctactaagaatacaaaaatgagccgggcacggtggcacgcaccttgtaatcccaggtactccgaagatgaggcaggataattgtttgaactcaggaggtggagggttgcagtgagccaa

SEQ ID NO: 17538 - DNA, 483 bp, Homo sapiens
tacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcacgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcacgcctataatcccagcaccttggaaggccaatgagagtggatcagttgaggccaggagtttgagaccagcctggccaacatggtgaaatgccgtctctactaaagaatac

SEQ ID NO: 17539 - DNA, 544 bp, Homo sapiens
tgttcctgcagcacctaatgtaaagtgccttgcmagggtaggtgctcatgacgtgtagaatgagtgagtaacttcctgcctcataaggatgaaatgtggttcacttcccctgtgttcaacactacaaagctactcctgccagaagagggcagagttctttcttgggtttgaactggcttttttgggttgaaccagatcatcccacatccttagcactacttaaccttcttttcctgaagattacatatcagtgtcctgcgtttttatctaatattagagctgaggttcctaggaaaattttgaagtggggaagattatggagaaaatgaaatcgcaaatttggggagggtggtttgtcagtataaggccctgtggggtaatcatattttagttattacttgttaaaagggtaacagaacctctgtttctttaccaagtcgctggttggccatttctccaattgatgaactaccattggttttagctctttctcatttgggattccctcaatttgcttacatgattctggtacttagagtctaat

SEQ ID NO: 17540 - DNA, 394 bp, Homo sapiens
tgccacaactgcttctaaggcctcctccttctcctcctcctcttcctcttcctccttttccttctcctcctcctctcttcccagtgacagcatcatcgtgctgtttgcctgtattggctatgcttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatactaaaaaaaaa

SEQ ID NO: 17541 - DNA, 424 bp, Homo sapiens
atcatttggtccaggacaggcagtaggcgtcagggggcgccctaaggctccacggcatgtgcctgtattgctgggacatcgagccttcccaagtcaaccctgaaggaccaagacaacatcatccttcagaggtcactgagcggcasttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaaaaaaaaaaaaaaaa

SEQ ID NO: 17542 - DNA, 481 bp, Homo sapiens
agaatcttcgtgagagaagcgtctcagttcattggaacgagtagatataagcctcgaccggtttgagaaataaagggacagagtacaaaagagagaaattttaaagctgggcatccgggggtgacatcacatgtcggtaggttccatgatgccccacaagccgcaaaaccagatgatgttctamaracttcgagaatctagtggcatctaatatggaatgattcttccaggaagacgtttgtaatgctcactcaggaaatatcagtgaatacttcagaaagcttaatttctttacaacagaagctcgtatataaaatttaatttttaataaaaccttttctcagtatgttggcctttttgtcccctgcgatcccaaagacaatggaatgccccctgggatcccaaagacaatggaatgcaaatactakwaacttttcacaacttagatctactgtagcttttttcccaacacaattgtgaa

SEQ ID NO: 17543 - DNA, 400 bp, Homo sapiens
catgattatgttagattgtggatatttagaaagaatatcacgcaagggaagtgcttttcttaccatatcaagaaaagggtatgatattaacattatttattaccagtgatttgaactttgatcacttgggtaaggtggtgtctgccaggtttctccactgtaaagttactatttttacttttccatcatggatctgttagaagcccagctcacccttagggtagggragctaagctctgccttcttgagagagaagtaccaaataatttgcaggcatgtttaaaccaccatatagatattttcggggagatactttgatactatttctccttaaaggtttgactagtaattttagcattcatatgtatttttttttttycctgtaggatcagttgycttt

SEQ ID NO: 17544 - DNA, 468 bp, Homo sapiens
tgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtttaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacmgaatttactttgcagaa

SEQ ID NO: 17545 - DNA, 257 bp, Homo sapiens
agagacgtgaackgtcgttgcagagattgcgggcggctgagacgcgcctgcctggcacctaggagcgcgckragccccgacaccgccgccgccgccatrgagtccgagaccgaacccgagcccgtcacgctcctggtgaagagccccaaccagcgccaccgcgacttggagctgagtggcgaccgcggctggagtgtgggccacctcaaggcccacctgagccgygtctaccccsagcgtccgcgtccagaggacca

SEQ ID NO: 17546 - DNA, 502 bp, Homo sapiens
aaactgaccctaatcttggacattagtaataaaaggcacatattaataaaagacacattgacctagattatgtttaacaaaactttaagttatttaaattatgctaacacagcatatgtagcacattttagaaattcatagatcttttatttttctagtgttaaacaattacttcaaattgatttgtattgctacataaggcaaaaaacaattcctgaactttgcagaatggaaaaatatttcaactgccacatttactcttttaaaactgagagctttaaagcaggagctcccaatccccggtacccatccctggcctgttagaaactggacatagcaggaggtgagtggcacgcaagccagagaagctttatcagtatttacagctgctcccaatggcttgtatggccacctgagctccgcatcctatcagatcattggcagcattaaattctcataggagcatgaaccctattgtgaactgtgcaagccagggatctag

SEQ ID NO: 17547 - DNA, 293 bp, Homo sapiens
agttttgaactttataaaagggtcctgtcacccaaagagctgggggactctaagtttctgagctggtccttagcagttctttctgctcctctccccaacaacttgaggcccatgggcttcttggtccccctccagggcagggtgtctggcagatgcagtctttcatgtctaggtggggctggagctgggacgctagcagctctcctgtaccttctggacctgctgtctccaggccgacatccagccacttggcctcctttccttgcagaaatacacgcttttgagaagagtwa

SEQ ID NO: 17548 - DNA, 437 bp, Homo sapiens
atcatttggtccaggacaggcagtaggcgtcagggggcgccctaaggctccacggcatgtgcctgtattgctgggacatcgagccttcccaagtcaaccctgaaggaccaagacaacatcatccttcagaggtcactgagcggcagttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaaaaaaaaaaaaaaaaaaaaaaaaaaaar

SEQ ID NO: 17549 - DNA, 405 bp, Homo sapiens
  misc_feature 212: n=a, g, c or t
tttggaaaccgcggagtttcctttgggaggctgcggcagccgggctgacttgttatgttgggctccggagccgttaagagccgagagagacatgaggtgtctctgaagcccggtcgcctgggccatgaagaagatttttagtaagaagggcgagtcgcctttggggctccttcgcgcggcggcggaggagcagctcgggaggcgggggcganccgggggagggcgcctactcgcagcccggctaccacgtccgagaccgagatctcggcaagatccacaaagctgccagcgcgggtaatgtggcgaaagtggcagcagatccttttgctcaggaagaatggcttgaacgatagagacaagatgaacaggacggctctacatttggcctgtkccaatggtcatcca

SEQ ID NO: 17550 - DNA, 460 bp, Homo sapiens
atttggcctgtgcattttgatcgcggttaaatgcagtttctgttaggctctttgaaatattgaaaatagctcacaaactctcattactgcctttgaagagccacaggggtctgggaaccccaggcagggaatgccgttcttgtccaatttctcctctacaccctcaacaccccctcccttacttcccctctcaagtttggaatgaactgcctaaaaaacacaagaggagtcacatggagagatcaaaatgtcagcttcattaccttaccgataacgctgattggaagacgtggctttggatatgtggcaaaattgtcttgttaatacatcactcttgaattgaagaagttacccactcattcaccagcaaaggaaacagcctcaggcttccctcacaggagcaaggcttgctgggtaagttaagggggtgcaargtgggttggggctgagctaagtatgc

SEQ ID NO: 17551 - DNA, 393 bp, Homo sapiens
tattcatcatttcccaacaagaaataggtttatggtctctaataagtaatatcttattgaacataaaacattgattataggatatactgtgactgtatatactcctatggaaagaaaaaaragggctcccaattaaactatgacacaaagctttcttatcacttaggatttttagtttttatttactgaaatagttctttgagacttttaaaaataaatttgtcttatctaatactttgcataaataaaaaagaaaatacaggcagaattacttttggtattcttaaatttacgkatccctcattttccctacattcggagtctgtctcttctgaatgacttttttcaaattatttttattatagammtttgtaaatgtataaaacaagagag

SEQ ID NO: 17552 - DNA, 165 bp, Homo sapiens
acgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcrgccccagtagccgcgggccttggg

SEQ ID NO: 17553 - DNA, 432 bp, Homo sapiens
aattttttctcacaaggactgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaastgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaa

SEQ ID NO: 17554 - DNA, 429 bp, Homo sapiens
  misc_feature 35: n=a, g, c or t
atcatttggtccaggacaggcagtaggcgtcaggnggcgccctaaggctccacggcatgtgcctgtattgctgggacatcgagccttcccaagtcaaccctgaaggaccaagacaacatcatccttcagaggtcactgagcggcasttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaaaaaaaaaaaaracgagsgg

SEQ ID NO: 17555 - DNA, 378 bp, Homo sapiens
ttttctcacaaggactgggtgaagagttctgcagccttacagagactggaaaagaagcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgccatgctgttccggctctcagagcactcctcaccagaggaggaagcctccccccaccagagagcctcaggagaggggcaccatctcaagtcgaagagacccaacccctgtgsctacacaccaccttcgctgaaagctgtgcagcgcatt

SEQ ID NO: 17556 - DNA, 300 bp, Homo sapiens
atagcgcgtaacgagagactgcttgctgcggcagagacgccaggggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggcttgcatggtgctcaccccctcacccctccaagctcactccccaacccccaactccgtgtggtaagcaacatggctttgatgataaacgactttactctaaaaaaaaaaaaaaaaaaaaaaaaaa

SEQ ID NO: 17557 - DNA, 416 bp, Homo sapiens
aaggggtgcagctccagcagcaatggcagtgacggcgttggcggcgcggacgtggcttggcgtgtggggcgtgaggaccatgcaagcccgaggcttcggctcggatcagtccgaggatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggttttaacta

SEQ ID NO: 17558 - DNA, 369 bp, Homo sapiens
agcgcgdacgagagactgcttgctgcggcagagacgccagaggtgcagctccagcagcaatggcagtgacggcgttggcggcgcggacgtggcttggcgtgtggggcgtgagggacattccaagccccgaggcttsggctcggatcagtccgagaatgtykaccggggcgcgggctccatccgggaagccggtggggccttcggaaagagagagcaggctgaagaggaacgatatttccgagcacagagtwgakaacaactggcagctttgaaaaaacaccatgaagaagaaatygktcatcataagaaggagrattgagcgtytgcagaaagaaattgagcgccatwargchgaaggatcaaaatgct

SEQ ID NO: 17559 - DNA, 496 bp, Homo sapiens
cacatctctctggagttttctattttaaagaggaatctgaaagcaataagctctttggtcttcttaagatggctacacctcaatttaagatggggtattctttcactagttgaggagtagaagaggatgaccagctagactcccatggaattggaactsctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataa

SEQ ID NO: 17560 - DNA, 822 bp, Homo sapiens
cttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaattgcataggttactctcagtatatgatactctgtaacatttctatttatatcggcataaatttcattttttttcttcatatgcaatgtggttatataaag

SEQ ID NO: 17561 - DNA, 424 bp, Homo sapiens
tgttagaagagcgtctaaggttagccactctcaaggggaggggaattgggctacatctcttagtgggagaagtatcaaagaatctgtgggcatattttaaagccatcacactcattatggttttatttaattaattaatttatttttttgtagagtcagggtttcgctatgttgcccaggctggtcttgaactgctgagctcaagcagtccacccgccttggcctcccaaagtgctgggatcacaggcatgagccaccatgcccggctctcattatggtcttagtttatttttttaatttgagacggagtttcattcttgtcccccatgctgaagtgcaatggtgccatctcagctcattgcaacctccacttcccgggtttaagcgattctcatgcctcagcctcccgagtagctgggattac

SEQ ID NO: 17562 - DNA, 433 bp, Homo sapiens
cataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgcttttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctt

SEQ ID NO: 17563 - DNA, 260 bp, Homo sapiens
agacgaacggaagatggcggcggcggcggcggcggagtgtaggaagaggcactgctgagggggcgcgaggggaacggaggccagagctgcgaggttagctgggcatggtggcatgtgcccgtaatcccagttgcttgggaggctgaggcgggagaatcacttgggcctgggaggcggaggttgcagtgagctgggatcgcaccaccacactccaacctgggtgacagagcaagacttcatctcaaaaaaaaaaaaaaaaa

SEQ ID NO: 17564 - DNA, 435 bp, Homo sapiens
aggccagcggggggtcgctgccgttgagsttcccgccactgctgctggcggatttgtggggcaaaatttctcgctggctagccttcttttccctcccgcactttggtggggagggggtggatcctygtttcggtgcccaagttcacgatgacccgagagaactcgaggaagttgtcgccgcggccatttcccccagtgccgcaacttgctggccttggagggggaggagcgccgaggcagtgactgcgacgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgagtttaagaaaatttttttcccagtat

SEQ ID NO: 17565 - DNA, 284 bp, Homo sapiens
gacaagaggcatcctaggaaagggagcagaggaagaggacagagacattttctttcttttctttttgtggacgcaacggcatgtgcctgtagtcccagctacttgggaggccaaagcaggaggatcattcgaagtcagaagtttgaggctgcagtactttatgatcacacctgtgagtagtcactgcactccagcacaggcaacacagcaagaccctgttctttaaaaaaaaaaacaaaaaacaaaaaaaaaaamcccaaccamccaaaaaaaaaaaaaaatgc

SEQ ID NO: 17566 - DNA, 390 bp, Homo sapiens
cagcttaatgaaaataatttcagtaaaatgaaaatggaagaaatggagttggtttaactgtgacttgtggtcattattattattttgactttgsamcaycckggaatgcdatatgagcattctgtgttcatgtagctctttctcattctttttaatgactattatttcattgcaagaatctacagtaatttattccaacttaaaaaaaactgttctgttttccagaatatgcttttaaggctattaaccagggtggccttacatcagtagctgtcagagggaaagactgtgcagtaattgtcacacagaagaaagtacctgtaagtaatactgcccaaatagttaataattgcagaatataagaatttttcagccaagtgcagtggctca

SEQ ID NO: 17567 - DNA, 325 bp, Homo sapiens
aagagtgtcctagagcccagaaataatcaggctggaaatgctcctaggcttggagaagactcattcaggggcaaagctgtaactcctatcgacacagggcagggcccaggatgaatgtcataaggacagctgaactgtgagccctgggatgaagtcacctacagccctaagacctgaaatgcacatctcagcagaagcctgactgcagccgttatccttgctgtggagatgaaccaaaggcccaagcgtgagtgacttcaagatgaaactcaggagctgaggctcagtgtggacattaaatttccgatgccagataagaaaaaaa

SEQ ID NO: 17568 - DNA, 442 bp, Homo sapiens
aggagtcactgacttagaggtggtagtttcaagtgacgtgatggttaagttcaccaagagaaaaagtttagaaagaaaaagagctgagccttctgccctattttttagaagagggtttctgagagcctgggtattcaaatgataagatgggtgtgtggtgcagggacaagacttcagtcagaggacccagggtctctgctttasaccatcttgctgtgtgacgttgggcagctgaccttactatcagtgcctcagtttcctcccctgtaaccagggacaataatgccagccctctctccctcccaaaattattgcatggatcaaaagggagaatgcacaagaaagtgctttgtaaaccactcaaaagactcatcaaatgtaagggattattataattgcagtgggagatgcaggaggccaataaaatggatttggttgcagt

SEQ ID NO: 17569 - DNA, 628 bp, Homo sapiens
actctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttycctttttatgtgkgatatagtagttacttgtgacaagaataattttggaataatttctattaatatcaactctgaagctaattgtactaatctgagattgtgtttgttcataataaaagtgaagtgaatctsaaaaaa

SEQ ID NO: 17570 - DNA, 411 bp, Homo sapiens
agaatgggaagaggtatgtcttgagagaagctcacggtttacttccacaattataaaatgacagcaggccgggcatggtggcgcatgctgtaatcccagcactttgggaggccaaggtaggtggatcacctgaggtcaggatttcatgaccagcctgactamcatggkkraaccccgtctctactaaatacaaaaaaattagccaggcttggtggcgcatcactgtaatcccagctacttggaagactgagacaggagaatcacttgtgtctgagaggtgctcgacgtgtcccttctcttcctccgggtcatcagcgcctgtgcagatggcaagatccgaatttacaatttcttcaatgggaactgtatgaaggtgataaaagccaatggcagaggcgaaaaaaaaaaaaa

SEQ ID NO: 17571 - DNA, 547 bp, Homo sapiens
agcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggctcaacaagggccacaaagtgaccaagaacgtgagcaagcccaggcacagccgacgccgcgggcgtcttgaccaaacacaccaagttcgtgcgggacatgattcgggaggtgtgtggctttgcccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaaa

SEQ ID NO: 17572 - DNA, 443 bp, Homo sapiens
gtagatatcccggagttccgcgcggcgccacccttccgccacggccgtctctggagagcagcagccatggccctacgctaccctatggccgtgggctcaacaagggccacaaagtgaccaagaacgtgagcaagcccaggcacagccgacgccgcgggctctkgaccaaacacaccaagttcgtgcgggacatgattcgggaggtgtgtggctttgcccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaaaaaaaaaaaaaaaaaaa

SEQ ID NO: 17573 - DNA, 70 bp, Homo sapiens
cttccgccacggccgtctctggagagcagcagccatggccctacgctaccctatggccgtgggcctcaac

SEQ ID NO: 17574 - DNA, 1157 bp, Homo sapiens
ttttaaaagatatcgatacctgtttggtcactctttctaattttggcttctgctcctccgtttctttacttagttgaaatgaataagcctgcttctctgataacttttctttaacattatttgccaaatgttctataacatctaatgtattttccatgctctgtagaaaaaatattaacatgtattttttagaatcagaaattgacttttataacttgtcatttatcaagtattcatttaattttaattcatttatttttgtacataatatacattatttctgttgatgtacctcttaatgacatctcggtcaatgatggactgtatatatgatggtggtcccataggattataatggagctgaaaaattcctgttacctagcgacattgtaatgtggcacaatacattagtcatgagtttgtggtgatggctggtgtaaacaaacctgcattgccagtcatataaaagtctagcacatacaattatgtacagtgcataatacttgatagtgataataaaagatattactgatttatgtatttactatacaatatacttttattattttacagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgtagcctaggtgtacattatttatcatgtctacagtagtgttcagcaattaggccttcacattctctcaccactcactcactcagtcactcacccagagcagcttccagtcccgcaagctccatttatggtaagtgc

SEQ ID NO: 17575 - DNA, 228 bp, Homo sapiens
tatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagc

SEQ ID NO: 17576 - DNA, 421 bp, Homo sapiens
gttagtgacattggaatctaggcagttgcacaacccttttaatgtcagtcttggaatgaagactttatgcatcactagctgtgtgcatgtatggtgaggtcgtgccagcaaatccgtgtgaatgccactggattaaaagaaggaagtttagttgaatggttactaccctcattcacaggagcagttatcggcacttccattgaggcaatggcagtgggaaaaggaaggcaaatatttattcacccatcaataaactcataaaagagtgagctgatgaactgaacacaagttttggtgtaatcaacaagctgcctggaatatgcatgaactgccctaattttacagatgcctttacttctgaaagcatcttctgggagagcttagccttttccctaagtttggatttgaaagcaagcagaat

SEQ ID NO: 17577 - DNA, 554 bp, Homo sapiens
ttttcacttgcctcatatgtgaggcattgagtccttttgtcttctcagtatgaaaaagccttttaataagtgttactagttttaagaaaatactgacttacccagaagaattgcaaataagaattgctgaatatacatgaaaatcaacatttttaaagcagagatttgtgatgagtggaagacggaatctagattaaaagtatctcagcttctaaagaattgtcctttttaactgtgcagcagacttagcatatctttatgataaaattgattgtacgcaacttgagcatagctttctcttctggggtaatgtgaagtaattttcaattaggggtggatcacctgaggtcaggagttcaagaccagcctgacgaacatcatgaaaccccttctctactaaaaatacaaaaattagccaggcgtggtgacctgtgcctataattccagctactggggaggcagacataggagaatcacttgaacctgggaggcggaggttgcagtgagccgagatcgcaccactgcactctagccttagcgacagagcgagactc

SEQ ID NO: 17578 - DNA, 183 bp, Homo sapiens
accgtccggcgcgatggcggggagtagctcgctggaggcggtgcgcaggaagatccggagcctgcaggagcaggggacgcgctgaggagcgcgcgggcaccctgcagcgcgactggaccacgagaggaagaaagaagaaaaaaagaatagaaaagagsaaraaaraaaaraaaataagaaaaa

SEQ ID NO: 17579 - DNA, 253 bp, Homo sapiens
aaaagcgatctcttctgaggatccggcaagatggcagaagtagagcagaagaagaagcggaccttccgcaagttcacctaccgcggcgtggacctcgaccagctggcarsatggtgggsgtctacaacggcaagaccttcaaccaggtggagatcaagcccgagatgatcggccastacctgggcgagttctscatcacctacaagyscgtaaagcatggscggsccggcatcggggccacccactcctcccg

SEQ ID NO: 17580 - DNA, 368 bp, Homo sapiens
agtctcgcgataactgcgcaggcgcggaccaaagcgatctcttctgaggatccggccaaratggcagaagtagagcagaagaagaagcggaccttccgcaagttcacctacctcggasgtggacctcgaccagactgctggacatgtcctacgagcagctgatgcagctgtacagtgcgcgccagcggcggcgggctgaaccggggcctgcggcgggaagcagcactccctgctgaagcgcctgcgcaaggccaagaaggaggcgccgccaatgggagaagccggaagaggkgaagacgcacctgcgggacatgatcatcctacccgagatggtggggcagcatggtgggcgtctacaacggcaagac

SEQ ID NO: 17581 - DNA, 556 bp, Homo sapiens
ttttaaaagatatcgatacctgtttggtcactctttctaattttggcttctgctcctccgtttctttacttagttgaaatgaataagcctgcttctctgataacttttctttaacattatttgccaaatgttctataacatctaatgtattttccatgctctgtagaaaaaatattaacatgtattttttagaatcagaaattgacttttataacttgtcatttatcaagtattcatttaattttaattcatttatttttgtacataatatacattatttctgttgatgtacctcttaatgacatctcggtcaatgatggactgtatatatgatggtggtcccataggattataatggagctgaaaaattcctgttacctagcgacattgtaatgtggcacaatacattagtcatgagtttgtggtgatggctggtgtaaacaaacctgcattgccagtcatataaaagtctagcacatacaattatgtacagtgcataatacttgatagtgatataaaagatattactgattatgtattwctatacatatcttta

SEQ ID NO: 17582 - DNA, 311 bp, Homo sapiens
  misc_feature 145: n=a, g, c or t
ctggttattttgcccattagttgatgcagtttcttcatagtgtcaatggtctttacaatttggtatgtttttgcagtggctggtactggtttttcctttttatgttttatgcttcgttcagaagctcttgtacagtgcgcgccangcggcggctgaaccggggcctgcggcggaasagcactccctgctgaagcgcctgcgcaaggccaagaaggaggcgccgccatggagaagccggaagtggtgaagacgcacctgcgggacatgatcatcctacccgagatggtgggcagcatggtgggcgtctacaa

SEQ ID NO: 17583 - DNA, 341 bp, Homo sapiens
ctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccasscggcggctgaaccggggsctgcggcggaagcagaaactccctgctgaagcgcctgcgsaaggccaagaaggaggcgccgccatggagaagccggaagtggtgaagacgcacctgcgggacatgatcatcctacccgagatggtgggmagcatggtgggcgtytaaaacggcaagaccttcaaccaggtgggagatc

SEQ ID NO: 17584 - DNA, 422 bp, Homo sapiens
atcacaccttcctcctgccctgacttctcatatcttgcctaggaactccaggcttgtcttgagttcctaggcaagatggcagaagtagagcagaagaagaagcggaccttccgcaagttcacctaccgcggcgtggacctcgaccagctgctggacatgtcctacgagcagctgatgcagctgtacagtgcgcgccasgcggcggctgaaccggggcctgcggcggaagcagcactccctgctgaagcctgcgcaaggccaagaaggaggcgccgccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcg

SEQ ID NO: 17585 - DNA, 239 bp, Homo sapiens
  misc_feature 148,152,237: n=a, g, c or t
ctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccaggsgncggnctgaaccggggcctgcggcggaagcagcactccctgctgaagcgcctgcgcaaggccaagaaggaggcgccgccatggagaagcngg

SEQ ID NO: 17586 - DNA, 379 bp, Homo sapiens
ctttaattccttagtctcccttagccatcaccaagatctttgttttactaattatattttacttcttcccatagctactatcattactctaattcaggccaccttattattgccgcagcttcctgttcttctcctttgttttatttaattaaaaattttgaaaccatcctgggcaacatggtaaaaccccatctctactaaaataccaaaaaattagccgggcatggtggtgcgcacctgtaatcaaagctactcgggaggctgaggtgggagaatcgcttgggcccgggaggtggaggttgtagtgacccaagatagtgccactgtactccagcttgcgtgacagagtgagactctgcctcaaaaaaaaaaaaaaaaa

SEQ ID NO: 17587 - DNA, 472 bp, Homo sapiens
ttggtggtttccctaaataaagcttgccctatagttcgttagcaagcgccattgaatcatttttttctttaacgagcgctccatgactgctgtcaggatcctctgtcacagcagggaccacttctttccaaagaccatgtgatagacctctttgagacaggagaactggagttcattaaaaagcatgccttggccaggcgcagtggctcacaactgtaatcctagcactttgggagaccaaggaaggcagatcacgaggtcaggagattgagactatcctggctaccatggtgaaacctatctctactaaaaatacaaaaaattagccgggtgtggtggcacgcacttgtggtctcagctactcaggaggctgaggcaggagaatcgcttgaacccgggaggcagaggttgcggtgacccgagatcgcaccattgcactctagcctgggccacagagtgacactccgtctca

SEQ ID NO: 17588 - DNA, 480 bp, Homo sapiens
  misc_feature 338: n=a, g, c or t
attcatcttgttttaaatgtggtggtccccatggagtctggatgtggcgtgcatgacctcccatggtcctgtaataagatctggcatgctaacaacattggctacagatctgtcatctataggtctgtctgtccctccccctccctcatctccttatctaaggttgaagaataaatgagcaattgaagcacatgggacctctagatgaaattgggtaaatatgtaagcaaagtggagggtgtgcttttgtgttgctaggacatatattatggtctctccttcccactttcactacacacatatgtggtcagtatggtaaaggaaagctgtttccttanttgcttttattgagggaatgtggcttgtaatcatccctgatgagtgctgggaagtgagagctcagtgcagagctggcaagcaaagtagaacttcagaatcactcctggtggggctgggggtagggtggtggagaaaaaaaag

SEQ ID NO: 17589 - DNA, 194 bp, Homo sapiens
agaagggcctatacttctaaaggttgaaagattctttttcaaaagatgatctaagaaatgtaggaccagtagatgctcaagtatatcttgaagaaatgtcttggaatgaaggttggattttttttttctcttgacaacatttaaaaaaaaaaarggawtttyctataagaaaaaaaamcysatgggatattggg

SEQ ID NO: 17590 - DNA, 364 bp, Homo sapiens
ccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggac

SEQ ID NO: 17591 - DNA, 478 bp, Homo sapiens
ctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatatctgtgtgatctcttttwttwtctttttgcctatctgcatcttctcacttgccaaaaaatgaaatatatgtttatgtgtgtatattacttgtgtcacaaaaaaccctaaagtagacagtaaaag

SEQ ID NO: 17592 - DNA, 475 bp, Homo sapiens
atgtttgtttgtttttgagacagagtctctctctgtcaccaggctggagtgcagtggcacaatctcggctcactgcaacctctgcctcccaggttcgggcgattctcctgcctcagcttccctaatagctgggactgcgggtgcccatcaccacgcccagctaatttttgtatttttagtgaagacgggggtttcgccatgttggccaggatggtctcgatctcttggccttgtgatccacccgcctcgacctcccaaagtgttgggattacaggcgttasacttgcgcccggctgagaattggacactttcaactggggccctgagaggctggtggcagcacacccagggtcattcagtggggaaggtttccggagtagggacgaagatggagatggggttggcttggggatcaggagtgaaggatgggaatgcagatggaatcagaggggaaaatggagataagatttggaat

SEQ ID NO: 17593 - DNA, 472 bp, Homo sapiens
tttccacagcgcgggggaacgggaggctgcaggatggtcaagctgacggcggastgatcgagcakgcgcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgcctgtctgacagaactcattctcaccaatarttagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatct

SEQ ID NO: 17594 - DNA, 344 bp, Homo sapiens
agtctcgctggcgggaggccacgggctttccacagcgcgggggaacgggaggctgcaggatggtcaagctgacggcggastgatcgagcaggcggcgcagtacaccaacgcggtkscgaccgggagctggacctccgggggtataaaattcccgtcattgaaaatctaggtgctacgttagaccagtttgatgctatkgatttttctgacaatgagatcaggaaactggatggttttcctttgttgagaagactgaaaacattgtkagtgaacaacaacagaatatggtacgtgtctgtaggggaaagtaattktttcccctagagtaaatgttgcagtgtttc

SEQ ID NO: 17595 - DNA, 503 bp, Homo sapiens
gttatacagattagagacatagcaagaaggtttgatttgattgattgtgtagggcaagggaaatggagaaggatgagtcaaggatgatagttctaagtttccgtaggagactggttgaacaaggatgccactcagtaaaggaaataatacatgaagaagagtaatgtgaaggccagggaagacagacaaataaattgctttggaactgttaagtttgctttgcttgtggacatccagatggaaattggttttatatgacttaaggctctggagagcaacctcgacttactggggtgggcatgagattgaatgtaattctccagaggaaaagttgtctatagcaagggtatttgctcatgacagaagccaatgaggggccgggctcggtggctcacacctgtaatcccagcactttgggaggctgagggaggtggatctcaaggccaaaagatcgagaccatcctggccaacatggtgaaacccgtctctactaaaagtacaaa

SEQ ID NO: 17596 - DNA, 439 bp, Homo sapiens
aattataaagtggctccagcagccgttaagccccgggacgcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaagagctcctgcagctgtccaaaccagagcttcctcaagatggcaccagcaccctcagacaaaatagcaaaccggaaga

SEQ ID NO: 17597 - DNA, 412 bp, Homo sapiens
acacacacccctgattccagaaacacaacaggagctgactcaaaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctgga

SEQ ID NO: 17598 - DNA, 385 bp, Homo sapiens
tcaccaagggaagagtcaggggagaaggaacacaagactccggaagcatgccagcgtataaaaccacactttgcctcattggttcgtgcctcagcttccaatctggacatggragsacaataacagtgggcccactgctctccgaattcctgcgcgcacttgaagggagtgtctggtgcaggcatgcagggaggaagaatgactctgagcttgaccattcaacttcgaaactttaacatcaatggatcagcacacactggtgtacggtvtgctatgcatgcagccctgtgctaggcaaaagaagtatcagaccaggaactgacagcctcactgcaacaggaagagaggcttcacacaataagcgtttcattcaaccaggctggac

SEQ ID NO: 17599 - DNA, 639 bp, Homo sapiens
tagtttttatagatttcaaagacttgggaaaaaatattcagggaatatctaggtgagtatcatagatttgatcccatctgctgaaaaaccagataattagaaaggtatatctatttcttttgctaactctggggcttctgcttacaaatagcttttattacccctcacacctcctgagctttattttatagtagaggaaggtcagtgtttcataagcataggtttgttaagtggttaagtacaattgtcccccagtatcatgggtgatcggtcctaagacacccctctggtaccaaaatccagggatgctccagttctttgtacaaaattggcatatttgttgtctgggcctggtggctcatgtctgtaatcctggctatttgggaggctgaagtgggaggatcacatgaggctgggagcttcagaccagcctgggcaacatagtgagaccccatctctacaaaaaattagctgggtgtggtggtgtgcgcctgtagtcctagctactcggggagactgaggcggggaggatcactgaagctcaggaattggaggctgcagtgagctatgactgcaccattgcactccagtsmgcctggtgacaggcaagcaagacgctgtctctaaaaaaagaagaca

SEQ ID NO: 17600 - DNA, 487 bp, Homo sapiens
atttttcttggttttgtttatcagccgatctgtttgctggatttgggcttggaatgacccacctgtaaagtgcttttccttcctcctccccttgaactctgcagggggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaaggaacactccaatatggcaattgacctcacctcaagcacacccaatggacagcatgcctcaccaagtcacatgacaagcacaaattcagtaaagctagaaatgcagagtgatgaagag

SEQ ID NO: 17601 - DNA, 425 bp, Homo sapiens
cgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacaggtagggagattcttctgttttttaagattccatctgctgatccttttgtagttcatgagcatgatgattgggtgttcacgtgcatgtgtgagatgtggcacccttgcacattactcgcctgacctgagtggggaaaaaaaaaaaaaaaa

SEQ ID NO: 17602 - DNA, 329 bp, Homo sapiens
tctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcgggacccggaactgatctgacaggatggcatctgatgactttgacatagattgaggccatgctggaagctccctataaaaaagaagaggtgaatgcctcaggatgagcaacaaaggaaagaagttaaaaaggattatcctagcaataccaccagcagcaccagcaacagtggcaatgaga

SEQ ID NO: 17603 - DNA, 92 bp, Homo sapiens
atcccgcgcgttgcggtcaagatggcgctggtggcttctgtgcgagtcccggcgcgcgttctgctccgcgcgggggcccggctcccgggcgc

SEQ ID NO: 17604 - DNA, 352 bp, Homo sapiens
agatttctgtttgctactgtgtcttatgccttgttctcctacagagaagattctttgaagttagtggaagctcagcttaaaggaagatctactgctctgtgtggtggatgaccatgggggagcgagaaggcagcctccggcttttgttttgtgtgtgtgtgtgtgtgtgtgtgtgatgtacctggaaaaataacacgattaggattaaagagtatgtttggcatgtttaaaataaattgtaaaccaaacgtattttaaagaatttatacaaatttgtcatttagtaaaatgaatgactattgagtattcatgtcaataaaacaaccacttgaatacaacaaaaaaaaaaaaa

SEQ ID NO: 17605 - DNA, 435 bp, Homo sapiens
aattatgattagcgctgggtgcggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaaatatttagactgtttaaaatagatcttctcatataagaatatctggtgaa

SEQ ID NO: 17606 - DNA, 504 bp, Homo sapiens
attttctcttgctgccgaatgtaagaagagccatacgcctcccgccatgattctgagacctccacagcgatgtgaacttgccgaataatatttcattttctggatatacctcactttatctacttgctacagaagggcatcctgcttactttaaagttttggcaattaggaataaagctgctataagcatccagtcctgcaggttgaaaaatccaagatcatggcactggcaggttttgtgtctgctgagggcctgatcttcacttccaagatggtggctcgagtgctgccttctccaggatacaggaatactgttcctcacatggaagaagtgaaagatcaatgaatccactcttgcaagccaatttttgctctgtttgtttgtttttgagacaaggtctcactctgtcaccctagaggttggagtgcagtggcacaatctcttctccctgcgacctccacttccctgctcaagtgatcctccccacctcagcctcccaaata

SEQ ID NO: 17607 - DNA, 228 bp, Homo sapiens
aaaaaaaccactttggtagtgccagtgtgactcatccacaatgatttctccagtgctcatcttgttctcgagttttctctgccatgttgctattgcaggacggacctgtcccaagccagatgatttaccattttccacagkggtcccgttaaaaacattctatgagccaggagaagagattacgtattcctgcaagccgggctatgtgtcccsaggagggatgagaar

SEQ ID NO: 17608 - DNA, 261 bp, Homo sapiens
agagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcaaaaaaaaaaaaaaaaaaaaaaaaaaaaaaaaaaaaaa

SEQ ID NO: 17609 - DNA, 222 bp, Homo sapiens
agagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 17610 - DNA, 269 bp, Homo sapiens
agagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcaaaaaaaaaaaaaaaaaaaaaaaaaaaaaaaaaaaaaaaaaaaaaa

SEQ ID NO: 17611 - DNA, 345 bp, Homo sapiens
agcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtaatttcttgccagtgtctctgagcttcataatatttttggtgattatgaagctcagagacactgcaagaaataacttttaatttaccggtcaaacaatggtattttaacagcagtgataacaatttacagtattggggattggattacccacctcttacagcttatca

SEQ ID NO: 17612 - DNA, 204 bp, Homo sapiens
agckgccggcgggcggcggggatacttctacatagacataatcaagttttgactatttggaaaccaagcatcattaaaattctctcaaactctcagagacactggcaagaaataacttttaatttaccggtcaaacaatggtattttaacagcagtgataacaatttacagtattggggattggattacccacctcttacagct

SEQ ID NO: 17613 - DNA, 504 bp, Homo sapiens
tggtatagctcattatctgtgctggattaaccagaatttttatattgtcatttctgttcaccaccattgtgtgtaattgatctttttcgattaacccaaagcaatgaagtagtcatatttactaaagttttagtttcgtgcgttttattgtattaacattttttgaatattggtaatgtggtatcatttatgaaccactgtatttgataaagcattatcgataacggagtttaccatgagttcagacaagataaattaaatatttctcaaactcctactgtgagtaaggcaatgtggagaaggtcaatggttatggtgagggatggggtatagggggctagaaatgtaggatgaccaaggttctcccctagttgctattgctgtaaaaagccccctgtccaaggagttgaactgcaagtatgtttaataaaaaaacaaaaaacaaacaactttcctttttccagtgcagaaaatttgtgagtatataatatcagggtttaaaaa

SEQ ID NO: 17614 - DNA, 442 bp, Homo sapiens
aatttgagccgcgtcgagctcccctgggacctgtggccgccgcccacagaccatgctcctggggcgcctgacttcccagctgttgagggccgttccttgggcaggcggccgccgccttggcccgtctctggagtgctgggcagccgggtctgcgggcccctttacagcacatcgccggccggcccaggtagggcggcctctctccctcgcaagggggcccagctggagctggaggagatggtccccaggaagatgtccgtcagccccctggagagctggctcacggcccgctgcttcctgcccagactggataccgggaccgcaggactgtggctccaccgcaatcctaccagtgtccgcccagccagataggggaaggggccgagcagggggatgaaggcgtcgcgratgcccytcaaattcagtgcaaaaacgtgctgaa

SEQ ID NO: 17615 - DNA, 169 bp, Homo sapiens
aatcctagtcttcgtttggtccggttgcactcttcctatagcccagaggggagagggcctgtggctgggggaaggaggacgaggttctgcctggatcccagcaggacgctgtgccatttgggaacaaaggaatagtctgcctggaatccctgcagatcttggggccgga

SEQ ID NO: 17616 - DNA, 458 bp, Homo sapiens
agtctggggcgggcgctcgggctgcgcgggctctgggcagcagcagcagcagcagcagcagcatcctctcttcctttacttcccttccgcttctttctcttccttctccttcttttttcccccctccccttcttcccctrcccttctacccctctcctttttctccggaggcgctaagtccgtgagcggtggcagtcgcgaccgcgggtgcatccagtttctgcgcccaggtaagagaccgtccccacctctggctctatgtagggcgcctctccttttgcctcggtctctgagtagaaagagataggaatggggaggggttgtgtctcgtcctctgggactcgcagcaggcagtctggtagttggtcgagtggccagccgtgcacctggcggaagattcgggcctgtcctctccaggtgtcactgcggacaggggccggacgctactggtacctgag

SEQ ID NO: 17617 - DNA, 399 bp, Homo sapiens
tattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacacaaaa

SEQ ID NO: 17618 - DNA, 476 bp, Homo sapiens
caaatttcaactcataggagcttctcatgaagttcatttttaagaatcatttcacattatcacagagacataatggctgatactacaaatgtttaagtgaccactatttgagctaaagtgcctttcccagaagctgattgcagtggtatggaacatttgatcattattatgggtcctctagtcttcttaaagggggaaatgaggcatttgctttcttctcagtgctgaggagtcatttggcttgattctcagaataattctaccatctgaaaggaatttacctcccatgttgtgtctgttgagtttatgaagtttatatcattctgtaagggatgagatagtttgaactgcaagtcccttgagttaagaatgactctaaaaacatcacaagtgatgggaggmaattaaaactttttgaatgtcagtcatataaacattgataaaaatggaatatatcagtttcgttgactgggtaa

SEQ ID NO: 17619 - DNA, 277 bp, Homo sapiens
actgttgaatatttgaagcaagatttcagattttagtttaggtgtaatagaattatccattctgaagtttaatttgctttacttttagctggcatgaaacacaaaacacttgatgaaaaaatttgattatctgggcaggtgcagtggctcatacctgtaattgcaatactttaggagaccaaggcaggaggattgcgttaaatgtacactgttgagttttctgtacataaaaataattgaaataatacaaattttccttcaaaaaaaaaaaaaaaaa

SEQ ID NO: 17620 - DNA, 462 bp, Homo sapiens
catttcgttctcccgccgmcgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgaggaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaaattcaagaagcagaaacccctcgcggagttttactggaagaaaaaaacgggtctgaaagattcctcctcttcatcatcatcaaccatcattcattca

SEQ ID NO: 17621 - DNA, 597 bp, Homo sapiens
atgattcccacatagcctgggtcctggataggatttagattccacagatactctcacagtgccatttggctgtagaaaagaactaaatgtgaagaaaagcaggatataaaacatttatttgctggcatgtatagaaatataactggtgtcattctgctgtcagcatgtcagaagattttagacttttctgcagtggttatgaaagctttaaccatgttacaggggcagactgatactggagtttgaaagctactcttggagacatgggctgcctactattttggccttccaacaattttataagaaactcaatagataacgataaataccttcaagcttaaaatcgcgattatgatttctgctgtgcgcaatgaaactctgagtgaaacagtcctccaggattttgaagtcctctgcatccgggcagtggaacagaagtgtggagaagattcatcatctgcttcttaaatgccctagtcagaaaggggtactcatcatttctgttcatattttatacggctacaaatagatgtgagaagagcaagaaaacatagtcctggcaggcagttgcttctgatgacactctgcactctggag

SEQ ID NO: 17622 - DNA, 249 bp, Homo sapiens
gcgcgccaagacggctcggatgccggcggtctctgctgaagagagaagatggcgcttgacggaccagagcagatggagctgcaggaggggaatgcaggcagcggactccgccaatattatctgtccaagattgaagaactccagctgattgtgaatgataagagccaaaacctccggaggctgcaggcacagaggaacgaactaaatgctaaagttcgcctattgcgggargagctacagctgctgcag

SEQ ID NO: 17623 - DNA, 221 bp, Homo sapiens
  misc_feature 132,198,204: n=a, g, c or t
atatactgggagaggcttctgggtcaaaggaccagtctgcagagggatcctgtggctggaacgtggagatcttctacagaggccagtggggcactgtgtgtgacaacctgtgggacctgactgatgccagcntcgtctgccgggccctgggcttcgagaacgccacccaggctctgggcagagctgccttcgggcaangatcangccccatcatkctggac

SEQ ID NO: 17624 - DNA, 243 bp, Homo sapiens
aatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaaaaaaaaaaaaaaaaaaaaa

SEQ ID NO: 17625 - DNA, 215 bp, Homo sapiens
aatcaagcatcagtcatataataccacagatttgaactcctgcccacaggggacctcccatctcctggcccctatcataggatcactgggcctacctgcactgtggggccaagcctgtctttttcccaagccctcaagcacacgcatgagtgttcatcccgacttggtagggggcttttcacccttacaagatggcaaaagattcacattgcttt

SEQ ID NO: 17626 - DNA, 279 bp, Homo sapiens
aatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaaaaaaaaaraaaaaaaaaaaaaaaaaaaaaaaaaaaaaaaaaaaaaaaaaaaaaar

SEQ ID NO: 17627 - DNA, 367 bp, Homo sapiens
attaaatgtggtgaaaggaacaggaaaagaagtgtctttcagaatagcttacatttccttcctgcttggcagaatcatttgtgagttcacataaatgggttcatgcagataataaccaagaaatgggaagacattaattagaattgatttacaattacacacctcactcaagcccattagttacattctgtttttcaaaattgctttcattttgtgagtgtgccagacttttaaagatttggtaagacttgatgtcagccttctccaaggcctttaatacatgataggtcagttgccaagagggataatttttttttgtaattaggaaataacattttaaacactgtatcctgtaaaaaaaaaaaaa

SEQ ID NO: 17628 - DNA, 700 bp, Homo sapiens
  misc_feature 658: n=a, g, c or t
cacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaaacatttctatcaaccgcaatttagtagcagtagtaacaccatagtgcagcacattatttaagtgtttatggtgctggtgtaaaacgtgctgcactttcagttgtataaaagtacaagacagcggccggggacggtggctcacgcctgtaatcccagcactttgggaggccaaggcgggcggatcacgaggccaggadatcaagaccatcctggctaacacggtaaaaccccatctctactaaaaatacaaaaaattagccgggcgtggtggtgggcgcctgtagtcccagctacttgggaggctgaggcaggagaatggcataaaccaaggaggccgagctgncagtgagctgagatccggccaacagagcgagactctgtctct

SEQ ID NO: 17629 - DNA, 388 bp, Homo sapiens
gagccgagacggtgcagggcgggagaagcaccttcactcccagcctgcgccccgatgctgcgcgttctgtgcctcctgcgsccctgggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaattggagtgaagggcgtgttctgtgcaggtgcagacctgaaggagcgggaacagatgagtgaagcagaggtkggggtgtttgtc

SEQ ID NO: 17630 - DNA, 381 bp, Homo sapiens
acttaactcataggaggcctgtgataaatgggagcttttatcatagactgactttcctgctcctgttttgcttcttctttatgtttaggtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaagatgaggaaactgaggtacagatgggaaacttgctcaagttcacacagcaattaagtgatcaagtccaagagcwaaaccatgcaggctggctccagagctcacgatagtccaccactgctttccacsatca

SEQ ID NO: 17631 - DNA, 443 bp, Homo sapiens
actggttgttcagcaccttcggtccggttgaggttgtcaagtcggaccaaacaggttgtttctctgcagtttccaacatggcagggaggtttaatagacatggataagaagtccactcacagaaatcctgaagatgccagggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacatcaaaaaaaaaaaaaaaaaaaaaaaaaaaaaaaaaaaaaaaaaaaaaaaaaaaar

SEQ ID NO: 17632 - DNA, 145 bp, Homo sapiens
taaatattagagtattcatgataaaacattttgagaaggggtaagcagtgagttattacccacaatttaaagcaaattttgaatgaatctttaagttaggtatctaccttcccaccagccccccaaaaaaaaaaaaaaaaaagct

SEQ ID NO: 17633 - DNA, 510 bp, Homo sapiens
agaataaaggtaaataaatggctttgtggtggtaattactggggtgtttggattgggaggaataaacattggtttatattttataagttcagtttcttggagaaaagggaatgtgtagctgttttactttaattatattttctctattctgcctcaaaacctagttgcggttgttccttgagcactgtggcatggagctgagtttctgtggctagatcttagcaaaaccaaaatacaagtggctttagcgccttgccccttctgaagctctgctgtcattacttcagcctgagctgaaatgctagctgaaaggcagggcaaatgaagaagaggagccactcgctgttcctaggcccagcacattggagatacaaagtagcataacccaaataccgagattatttgtttttagtatatgttaagaaagatagtagctatggtacgagagatacagcgtagtaaacattattgagacttgtttggggaagaagacccttggagaaatgcaaa

SEQ ID NO: 17634 - DNA, 471 bp, Homo sapiens
attctgggatccatggatgccagagaatctctgaacagagtttctattcggctttccacactctcaagtttagcctctgacatcttacctttcttgctcatggtttccttaactatgtatacatcccttaaatgaacatgaaatgatcataagccttcatattgctacaggcagcttgaatacagtctccagggtgttacccagagactgtggggtcatttccattctgtatctccaagatctcataagctaaaatagaacagattgagcgttcactcaccaacaacagaaaatttgggtcaactttggccactctctccacaccaattctatcattgctactgcaaaaccaaaatatccagtgaatgccattacagcattagaaatgaggaggctttttcccagcccttctgaactatggctattgctacctccawgacagtgagcctggtcacttctcttcctgcagaa

SEQ ID NO: 17635 - DNA, 440 bp, Homo sapiens
ttcaaacacaagcacggaagaagagattgcactgaccagagtaccgccaggtgtgatgctccgtagtcgcagggatgaaggaaaaccatgggcggasttgtsatggacagctcctaggtggacataaatggaaactcattggttctggggcacggcgggaagagggagacggmcctggacggccgcaccaagaatttcacaacccaaacccgactagaaagcctgggttatggccacaccgtgcccttgtcagatggaggtaaggccttctgcatcatctactccgtcattggcattcccttcaccctcctgttcctgacggctgtggtccagcgcatcaccgtgcacgtcacccgcagccggtccctctacttccacatccgctggggcttctccaagcaggtggtggccatcgtccatgccgtgctccttgggtttgt

SEQ ID NO: 17636 - DNA, 461 bp, Homo sapiens
aagagattctggttcctagagaggccagagatgtttgaagtatatcgccccaagtggcacggaggagaaagtgacacccggaaccgggaaaggacttgtccaaggtgaacgcaccagcgaccaggtctcctgccgctcagactggacttgtttctaccgttaatttggttctgcggtgcttcagagacagacagacccaagtcccaggcacagccccaccacccccttgcgttaacaagtctcttcaactctctgaatctgtttcctccgctatcagatggagattacaacctagctcaaaaggctgctgtagaatggccattaagtctgtgaaaagaggctcaacatgattagtcatagggtgaatgcaaagcacgaccacagtgagatcccacttcgcacccgctagatggccataaacaaaaagacagaaaagctcaagggttgcgagagtgtggaga

SEQ ID NO: 17637 - DNA, 340 bp, Homo sapiens
  misc_feature 106..107,141: n=a, g, c or t
atgaccggatgtctgtcacagtcatcaaggggtcttgtctgtaatgccaggaggtgtagcacgagatgggaaggtgggggacacactgaagcgaggaaatcctagnnggagggccagcctggaggggcgcaaataccgtcnbbcccaggccccgccccaccccggcagccagagccctgcaagcagtgggggctttctacataagaggcatccacgctgtgctgctctgaacattgagagaatgttaggctgggcgtggtacaggctatgctaaatcccagcactttgggaggccgaaggtgggaggattgcttgagcccaggakttcaagacggagcct

SEQ ID NO: 17638 - DNA, 518 bp, Homo sapiens
aaaaccaaacctatgcccaaatcccatctgtgtgggtttatctcctgggacccttcctaacatattagtcagagtccaatcaggaagcataaaccactcaaaagtttaaagtggtaaaatttaatacggagaattattcattataacaggtgaacagcataatgagagattggctagcacaaagtaaagagaactctagagaatacaggactagcccaggccaggcatggtggctcatgcctgaaaattccagcaatttgagaagctaatgcaggaggatttcyttaaggcccaggasctagagaccggtctgggacaacacagtgagaccctgtctctgtccaaaaaaaaagaaaaaagttagctgggagtggtggtgcacacctgtagtcccagctactcggaatgctgaagtttgagcctgggaggtcaaggctgcggcgaggcatgattatgccactacagtccagcctggtgacagagcaagaccctgtctcaaagaacaaaacaacaacaac

SEQ ID NO: 17639 - DNA, 534 bp, Homo sapiens
ctctctctcttctctaggcatgtgctctgagaaaaggtcatctgaggacaaagtacccgtctgcaagccaggaagagagcccttgccagaaactaaaccccgctggaaacttgattttgcgctttccagcctctagaactaatatgtgaaaaacatttaaatcagaaagtaaatgacaggatgatttgcaagacacagggatgtaaaattaaaaagcctctcgagctccaaagaaattactgtttaatattatatcatgttgaatttttcccaatggtaatcttatgatggctgcagctacctgttaacttcaacaagcacactggcctggagactacatgatggtgtctcagtaaaggatttacaactgcaaacatctcaagcagcagtgccacatccctgctacctccctgcttgtgcgtgtgtccctacattatccaaaataggggtgggctaatgacgattgcaggctaactccagcctaccacttgcttctataaataaagtcttattgtacaaaaaaaaaaaaaaatg

SEQ ID NO: 17640 - DNA, 667 bp, Homo sapiens
ttatagcaaatgcttcacagaagtagtgaggatacagaattgatcagagatagtcattagagccttcagaaagagcagctttggagtgagacagaaagactatattgaatttattgacgaacaaaagatctacaaatggagacaactcttgaggtttggtttgtttcttagtttggtttcttgtctttattggggggtagggcacacaaatagaatggtggctacagtgtcaaattgtttataaactttatactagccgtgtaacttgggcaagttattcaatatctgtgacactcctatttcaaaaatgtaacatggataaaatacttgcttggttttgctatagggattaaattagataaagtgacataatacatgtaaagtgcttggtcccataggcctggacattgttagcttgtattagttaatttataatgggtactttttccccctttgtcaatgatcccatccctaatacctagcacgtggctgttcacatagtatggatttaataaatggctatggaattaatgtacaatgagaagtaggttttatttatttatttttatkattcatwcatttatgtatttacttagtagagacagagtctcgctctgttgcccaggctaaaatgcagtggcatgatcatgaatcactatagctcgag

SEQ ID NO: 17641 - DNA, 351 bp, Homo sapiens
cacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtcaaaaaaaaaaaa

SEQ ID NO: 17642 - DNA, 459 bp, Homo sapiens
agatataaggctcctacctaatctatcctgcaggcatgctgctgccacacttcattaacctaacaaagaactatgattgctgatggagakacaagtaggcccttctgtgaaaggagaaatgggaggtggaatttgaatggactttctgtgtagaaggctcagaggtgattgtgctactgacagaggcctgggagtccctctgctgccgtcctacacccaccccgcctgccctctgacgggggaagcagaatcataggttctcaagaccaaaaggcaacttcaakggaagaagtgcggatgcgttttagagakgcttcattttgttcttgaaatcaakatcccccatgttcaagctctactaacctccctgagactcatgttcttatctacaaaatgggggtacttgatcataaactgttgtacaattacattaaacgatgtttagttaaaaaaaaaaaa

SEQ ID NO: 17643 - DNA, 515 bp, Homo sapiens
tagttagtgtcaaaaaagaaatcaatacatctagaagggggggcccgcctggctgcggttcagatgaaaagggtttgtgcacttcaggtgctgcggctcattccgagccagcagggaagcaaggaccgtcctggactgctttttttgtttttcagttttttattacatatatgaaacataaaatttgccattttaaccatttttaagtctacagttcagtggcattaagtacattcgcatactgtgccacccttaccaatatctgtttccaaaatatttcatcaccccaaacaggagctctgcacccttaaacaacaactccccatcccctggtcacctctagtctacttcctgtctctatgaactctgcacactgtttgtataaataaagttttattaggacatagccacgcccatcatttacacatagtggctgctttcactccacaagggcagagctgagtaattgcaacagagactctcttgccacagtgcctgaagcatttactatgtgg

SEQ ID NO: 17644 - DNA, 66 bp, Homo sapiens
aggacgtgttccgaggaagccagacccggagccgtggcctgccgggccggcgacatggatcccctg

SEQ ID NO: 17645 - DNA, 64 bp, Homo sapiens
akgacgtgttccgaggaagcyagacccggagccgtggcctrccgggccggcgacatggatcccc

SEQ ID NO: 17646 - DNA, 537 bp, Homo sapiens
caattattttagctgtttcataatcattaattgttatgtaagaagaatgtctgtgtttttccaggaatgcatacttgagtgtgtagaggtaaaatgacatgcctgggatttgctttaaaataatatcagcaaagagaaaaggagagggagaagataaacaaatgtagcaaaatcatgaaaagtattgaattaggctgatgagttaatgggagttaattcaagtcgtctttatctacttttgtgtatatttgaaatttttcattataaaaacatttatacagttcagggtttttggttgtcttttatgtccgtcaccactaactagattgtgtactctaaggaagggattacaacttgtttttgaatctctgttgctttatatagttgctgacattgtagcatagtgtatcatgcacatacagtgttgaataaattaataaaagcgtatttaattaagtatatgctgtcccacagtacttccctttctttctggagcttactcccatgacacttactactgctgcctctttctttgat

SEQ ID NO: 17647 - DNA, 501 bp, Homo sapiens
gagtgtttctgtgcaatgcaaattgctttggcttccacacagctcctgtcgcttcaagtgcggatgagtgttgctggagatggccactggagaggctgagtcaaatcaatctcctcacctgaggacttcctaagaccagcgcactgaaggaccagcagcaacaacaacaataatgctaatgctcccttatggacaagactgcaattctctgcctgctgaagctcagctatgaccacgtgacttgccttggccaatgaaagaggaagagtatgtaacactgctgaatggaagcaagtggcccctgcccctgctgcagagattctagacatgtgtgccatgctggagcaaggagacagggagtcctggagaaaggagacatggaacagagctcccagcccagtcaatatgtaacatgagtgagaaataaataacactttgttgctagaagttttttttaaactgaagtataactcagcttcccctgacccatgcagaaagtca

SEQ ID NO: 17648 - DNA, 159 bp, Homo sapiens
  misc_feature 116,141: n=a, g, c or t
tacaccgtcagastgctgagtattccgcattcaagctggagaatgagaggstkaaggcagctttkctccaatggrggacaaactcaaccaggcacamctcgaggtccagcagctgnaggcctcagttgaagaactattgangggattgatttgacaact

SEQ ID NO: 17649 - DNA, 140 bp, Homo sapiens
aaaaaaaacaccttgtgtaatgaaaaacccagatctataacctctccctatatattctgcatgcattgaagtaggctcaaaccctcagggacctggtatagacgcagaatctgtttcacacaacaactgctatttgaagg

SEQ ID NO: 17650 - DNA, 593 bp, Homo sapiens
attttaattatgtcggcctgcagtcatttccactgcccataatctaatgtgttttgcctgttgacatgttaaagatgggagccacttagagccattcttcgatcttgcccttcctacctcctcaaactgagagtatgagcatctgcttcaaggcacacacgttcccaattagctggtgtaaagtcacactaaaaccaagcaaaaagggttctgcaacataagggaaagggaagtggaggcactaagattgcttcggcagccaaaggattccttgggaacttgtaaaaggtagagtggggtgggtgacaatgaacatgtacttgtgggtttgttttctgggaatagtggaacctaaacttctacatctgaaaggaaaatagattaacctttttaaagtttattactgaatttttaggcctcgtgttttggacatgtgagtacaagccagtggtacagtgccagtcatttactgcgggcacctgagattgctactgatctacatcacatcagcaagccaatagttggcattagactatgtaaaaraacaaaatccaggccgggtgcggtggctcacgctgtagtcctagcacttt

SEQ ID NO: 17651 - DNA, 604 bp, Homo sapiens
aaaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggccttcatggcgggacgctccctgggaaaggctttagcgcgggtgtctctctctctggccttggctctgtgactatcaggtcctcgcgctgtcgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcagactataa

SEQ ID NO: 17652 - DNA, 333 bp, Homo sapiens
aactttgggggatgctatcctatttggtgattttcttgctttttctccaaggtaaagtcagaatcgattgaaatatcagtcactttctcactgacaaagtgacacagcagccgatgggagggttgacctgtgaggaatttgtggagcgtcaagccccagccagaggaaggagtcagactgttggagggcctgccgagaagtcacggcatccaatcttttgaccaaggggggaagcaatcctgtggttaaaaacatttgagaaaagagacctacagatagccttttgggcatactgtttcttggcacccaaaaaaaaaaaaaattgcgaaaagc

SEQ ID NO: 17653 - DNA, 98 bp, Homo sapiens
actttgggggatgctatcctatttggtgattttcttgctttttctccaaggtaaagtcagaatcgattgaaatatcagttccamcttttttccttcca

SEQ ID NO: 17654 - DNA, 322 bp, Homo sapiens
aaaaaaagcccaagggcctaggtaaacaatggacagcatcctggatgatgatgcaattttaagcctgaaaagaatatttggtcttcaatcttggcaagcatacctgtaaagtagatggtaaggctgctgatgagtaatcaagtcatagctggaatgtgabtgcctggctgatcttccaaggtccccttgcatctatgtgtggccttatgaatcaatccttgccaatggaaagtgaatggaagtgatgtgtgtcggtcccaggactgaccatagacctcctgcatgtgctccttaatgctatttcttcagttcagggtgggaa

SEQ ID NO: 17655 - DNA, 396 bp, Homo sapiens
  misc_feature 160,355: n=a, g, c or t
aagggcctaggtaaacaatggacagcatcctggatgatgatgcaattttaagcctgaaaagaatatttggtcttcaatcttggcaagcatacctgtaaagtagatggtaaggctgctgatgagaaccatttgagtaatcaagtcatagctggaatgtgantgcctggctgatcttccaaggtccccttgcatctrtgtgtggccttatgaatcaatccttgccaatggaaagtgaatggaagtgatgtgtgtcggtcccaggactgaccatagacctcctacatgtgctcctttatgctatttcttcagttcagggtgggaatgggaatgcccagagcaactttggaagctatangctgaggatgctagaactgccatcagcctgggaccctgaac

SEQ ID NO: 17656 - DNA, 487 bp, Homo sapiens
gaagtagatgatgctaatgaggatgactggatgtcacacccatgatgctattaggtcctcataatagcatagtgaggtggacagctagtacctgacccatctcacagatgaacatactaatgcctaacaaagcagaacgactcacgctgggtcccagagctggccagtggaagcactgagacctccacatactgaaggcatggactattgaccgctgttggtattggtctcatcattgactatcattaagtgttggctgtttgcatgcttcctgcccagtggcaggttcaaagaagcccgcagaagcgtgctcctttctttcccagggcccgcaattgggctggaagatagagcaacaaaaagcgcccatgtaactcatgggaacattcatgtgtgctgaatggcaggtgaaggtgccacagagaggctgaggatttcagagggcacatgaactggagtgaggtcgcagagcaggaacccaagacct

SEQ ID NO: 17657 - DNA, 170 bp, Homo sapiens
gagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttttttttttttttccttttaa

SEQ ID NO: 17658 - DNA, 511 bp, Homo sapiens
tatttttgttgttcattgttaatgctttagctctcaagtgtctgatgttcatcccattttctccttccttagtttataaatgacagtttattttcttaggattctcttatttatgttttttaactgtaaggattcttgacatgtaggtttttaaaatgttttattgtagtaaaatatatataacttaaaatcgaccattttactattttggtatacaattcagtgccattaagtatgttcacaatgggctgggctcgatggctcacgtctgtaatcccatcactttgggaggccgaggcgggtggatcacctgaggtcgggggttcgagaccggcctgaccaacatggagaaaccctgtctcttttaaaaatacaaaattggctgggcacggtggtgcatgcctgtaatcccagctactcaggaggctgaggcaggagaatggcttgaacccgggaggcggaggttgcggtgagctgaggtcgcgccactgcactccagcctgggcaacaa

SEQ ID NO: 17659 - DNA, 475 bp, Homo sapiens
gaaatgccttcatttggtttgctttcactgcaaaaaatctaataatttttttcagggtagagatgggtggtagttgacttaaagagtaagaatattacctacctcagcacaattagcaaatcagttatggtgggactagatattgacttttgcttwaattaggtatcaggaaagataccattcctggaggccagcatattttcatttttattcggatagctctcaagtgtctgatgaagtaagtaagaaaatgtcttgaggagaaatgggtttgttaaagataacatgtgtgatttcaaacctgaaaatgtgttgtagatagacaagaaaaggtcctccttctttaattactactgctcgaaattaacaacaccatcatcagtgtattgattgtgcaggaaaatgtgtttactcatgacatgctcacagatgctctgtgctgggagttgggctcttaagaggacctacttgggag

SEQ ID NO: 17660 - DNA, 314 bp, Homo sapiens
aaaaaaacacgacccaccttctagccctcctcccctttccccgcccactccgggctggccttatccagtagcgtctgggtccctggactaaagccgtcaaatgtaaccaattgctgaggagctctcccctaagaatcccgcctccactctgaggaacagcttcgctkatcaatggatcccctcctagacgcaatgagcgcgcggggcaaktggagaagcggctgaactgcccaatgaacaagcggtttccgtggttaggggcgtggcagaagcggtcgtcaggggcgtggcggmagttacttgggcggggccgg

SEQ ID NO: 17661 - DNA, 400 bp, Homo sapiens
ctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccytcsggrartttgahccyaaaggcttckgrakgccytkgacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataa

SEQ ID NO: 17662 - DNA, 443 bp, Homo sapiens
tataatgtgaattagtgctgtggtttaggaattggagataactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaa

SEQ ID NO: 17663 - DNA, 399 bp, Homo sapiens
aattaggtcaaggcatgaataaaatttctcccttgtttccactcaaaaactacaagtatagttccttgaaaatgtgaamtccgaccaagtgcagtggctcatgcctgtaatcccagctcgttgggaggccgaggcaggtggatcacaagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatacagtattttcctcaacttttaaaaaa

SEQ ID NO: 17664 - DNA, 404 bp, Homo sapiens
acaagtatagttccttggtaagatgctccaaccatggctgggtgcggtggctcaagcctgtaatcccagcactttgggaggctgaggcgggcagatcacgaagtcaggagattgagactatcctggctaacacgaaaatgtgaaactccgaccaagtgcagtggctcatgcctgtaatcccagctcgttgggaggccgaggcaggtggatcacaaggtcaagagatcgagaccatcctgtccaatctgtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccat

SEQ ID NO: 17665 - DNA, 200 bp, Homo sapiens
gttctcactcctatgacagaaaacgagggtgtggccagcaaaggacttcaaggcccatgatcccttagrrggggscsgsyksmwtwrgggkkgsyksykgkttkkwamskkscktkgttgggggctggggaggatttacggctctaaagccttccatataacgctttaacggtgggcagagcggtttctgttgcgtcccg

SEQ ID NO: 17666 - DNA, 509 bp, Homo sapiens
aacccactccggtccccttccgcgctgtggaagctttgttctttcactcttcacagtacattttgctccctctttggatctgtactacctttatgagctgtaacactcactgtgaaggtatgcagcttcactcctgaagtcagaccacgaacccacccagggggggaacaaacaacttcagacatgccacctttaagagctgtaacactcactgtgaaggtctgtggtttcattcctgaagtcagcaagaccatgaacacacccaaaggaaggaactctggacacatctgaacgtctgaaggaacaaactccagacacaccatctctaagaactgtaacactcaccacgaggatccacagcttcattcttgaagtcagcgagacaaagaacccactggaaggaaccaattctgggcacaatgactaaattcgggctgataacgagaaaggttcctgaccaaggggagtaaaggagatggaatgaagcttgtgtgctgtacttcaagtca

SEQ ID NO: 17667 - DNA, 483 bp, Homo sapiens
aacccactccggtccccttccacgctgtgaagctttgttctttcactcttcacagtacattttgctccctctttggatctgtactacctttatgagctgtaacactcactgtgaaggtatgcagcttcactcctgaagtcagaccacgaacccacccagggggggaacaaacaacttcagacatgccacctttaagagctgtaacactcactgtgaaggtctgtggtttcattcctgaagtcagcaagaccatgaacacacccaaaggaaggaactctggacacatctgaacgtctgaaggaacaaactccagacacaccatctctaagaactgtaacactcaccacgaggatccacagcttcattcttgaagtcagcgagacaaagaacccaccggaaggaaccaattctgggcacaatgaggttcctgaccaaggggagtaaaggagatggaatgaagcttgtgtgctgtacttcaagtca

SEQ ID NO: 17668 - DNA, 416 bp, Homo sapiens
  misc_feature 302: n=a, g, c or t
agtcaaattcaaattaaaaggtcgagacacgaatcagggaatattccgggaaagaaagagggaacctgcggasctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataaggggaaccgtatgtttcaaacagttatttccgtttctccatcgccttcttccaaagcganctaaactctccaccccttcctcaggaaacggagtctggagaacaacttgtctttcctgtcgccccacatttttccttggacagagcctagggttcagactttcagggctggagt

SEQ ID NO: 17669 - DNA, 255 bp, Homo sapiens
aaattcaaattaaaaggtcgagacacgaatcagggaatattccgggaaagaaagagggaacctgcggasctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataagggcaaaaaaaaaaaaa

SEQ ID NO: 17670 - DNA, 286 bp, Homo sapiens
aaattcaaattaaaaggtcgagacacgaatcagggaatattccgggaaagaaagagggaacctgcggasctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataagggcaaaaaaaaaaaaaaaaaaaaaaaaaaaaaaaaaaaaaaaaaaaa

SEQ ID NO: 17671 - DNA, 493 bp, Homo sapiens
cattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacggcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgtttttaaaaaaaaaaaatgtttcctaaatatttwacaccaggaaaaatatttttaaatacactggtgctaattgaaacag

SEQ ID NO: 17672 - DNA, 382 bp, Homo sapiens
agcagacattctcctccttgacactaggtgggtaggagcaggaggacagcggcctgccaacaggttgttccaggcgataggcggctttggggtcgccccaggagtccagctgcgagagaccaatgggatttgaaaatggccttgatgattcagacggccgtgacgtccgcggggtcaagttgtcggcaggcggasgcgcagagtggagtaacagcgccatctagcagctgcctcgggggaatattccgggaaagaaagagggaactgcggacctcggtcagtttggaggagtcacgtatcacacgggaaaccagcacacaagacgcaacaaaacccgacccagagaagcgtcctttacagagcgcacgggctgggagcatgt

SEQ ID NO: 17673 - DNA, 500 bp, Homo sapiens
atttccaactagctggcgggggcggaagatggcgacgccctcgggtggtcgaaggcggggtcaggatctgtgtgtctcgctttagatcaactgcgggacgtgattgagtctcaggaggaactaatccaccagctgaggaacgtgccccaggccctccctcagccaggctctgttgcagatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagagtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggccgtgctctccaccacggttatataaacgggctctttcctaac

SEQ ID NO: 17674 - DNA, 495 bp, Homo sapiens
atttccaactagctggcgggggcggaagatggcgacgccctcgggtggtcgaaggcggggtcaggatctgtgtgtctcgctttagatcaactgcgggacgtgattgagtctcaggaggaactaatccaccagctgaggaacgtgccccaggccctccctcagccaggctctgttgcagatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagagtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggccgtgctctccaccacggttatataaacggggctcttt

SEQ ID NO: 17675 - DNA, 435 bp, Homo sapiens
agccatttccaactagctggcgggggcggaagatggcgacgccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagagktagaggtgctatccaagcagctggagaaagagaagctggcctttgaaaaagcgctctccagtgtcaagagcaaagtccttcaggagtccagcaagaaggaccagctcatcaccaagtgcaagactcagtctcaaatacaaaa

SEQ ID NO: 17676 - DNA, 475 bp, Homo sapiens
gtattttaactaatggttgccttattaagaccatctcttccacagacaagtatatcagttatgcgctcttgtcattgttacaggaattatttaaactgagtcctaacagtgaaagttttacctgacttttgctgatttttttttctttctacatggggagatttatctctggagcatctcttgtgtttttgtatggtttgcttcagtagctagagaggctactatcaggaagtgaaatggatcatttctaatggtaggtctccattgcctacatggtatttctgagagtggtatcagggtgtccagtgaaagacggataggttgacatgtcatgctcatttggcctaaaggttgttactgccaggaatggacttacaacttaccagaatgtgaatggtgacaaaaggcakgttctactctggaaaaatatggtgttattttattagaagttcatggccgggcgcggtggctcacg

SEQ ID NO: 17677 - DNA, 217 bp, Homo sapiens
tagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaaaaaaaaaaaaaaaaa

SEQ ID NO: 17678 - DNA, 307 bp, Homo sapiens
aataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcaggccaggcggacggcgtgaggtttgtgttggggctggttctgcccatgctagggggtgggggagctcccaggacagaccagccttgtttctcatgtaatgcagtgacgctgtcattaaacacgtggattcatgtgcaaaaaaaaaaaaaaaaaa

SEQ ID NO: 17679 - DNA, 547 bp, Homo sapiens
acacgaatgcgctgctgttttaaaggaaaccatatataaattcgttgatatttttgtttttctaaataaaacagaacttttttctttcttactcctttcaagagacctttgagactatatttacagactttagcaaggaagtccaaactattttaactctgagccagactagaaaattcacggagaaatttttgacagaggatgtggaaaaagcgctgtaataggattttcaatggtgagtgaagggaacctcctctttttattttatttttgttgttgttagacaacaaatttttttttttgaacggcactgctccttgcggagtatggctaattcaaaggcagtacgcccagagtcggcagccttctctttttagagtcatgtcagtgtactggatcgcaagttgcaaacttccctttagtgacttgtaacttaaggacttattattttcaggttggttcaagacaacgccgccgaaaggaaggcgaatggggttgagggaaagagccgcgccttctcagtgtctctgaagtcacaaacataagc

SEQ ID NO: 17680 - DNA, 433 bp, Homo sapiens
  misc_feature 351,385,421: n=a, g, c or t
gactcgcactggagggcggccgagcgcttcctgcagttcgagatcgcctggttcgccgagccgctcttcaagaccggggactaccccgcggccatgagggaatacattgcctccaagcaccgacgggggctttccagctcggccctgcscgcctcaccgaggccgaaaggaggctgctcaagggcacggtcgacttctgcgcgctcaaccacttcaccactaggttcgtgatgcacgagcagctggccggcagccgctacgactcggacagtggacatccagtttctgcaggacatcacccgcctgagctcccccacgcgcctggctgtgattccctggggggtgcgcaantgctgcgatgggtccggagaactacggcgacatngacatttacatcaccgccagtggcatcgacgaccangctctggaggat

SEQ ID NO: 17681 - DNA, 497 bp, Homo sapiens
gctattttgaaggaaataacttcaccttaggatccaccattagttattactgtgaagacaggtaagtgaacacagcctgtcaaatgccagatcttgccccttggcagcattgttttggggaataacccagtctgtgtccacctggtcatctgatttcctactgctgcaggattctaagctcattctgattttgagagctgctttggccctctgctagctctcctcaatccctagaagacagactgatcctactaaagtatcctacttaccccaatgcaagtatctctttttcctctccgccaagacaagataaattatttaaaatgaatggatttggctgggcgtgatggctcacacctgtaatcccagcactttgggatgctaaggcaggcggtttgcttgaggccaggagatcaagaccagcctggccaacatggcaaaacccttgtctctactaaaaatacaaaaattagctgggcgtggttgcacactcctgt

SEQ ID NO: 17682 - DNA, 510 bp, Homo sapiens
gctattttgaaggaaataacttcaccttaggatccaccattagttattactgtgaagacaggtaagtgaacacagcctgtcaaatgccagatcttgccccttggcagcattgttttggggaataacccagtctgtgtccacctggtcatctgatttcctactgctgcaggattctaagctcattctgattttgagagctgctttggccctctgctagctctcctcaatccctagaagacagactgatcctactaaagtatcctacttaccccaatgcaagtatctctttttcctctccgccaagacaagataaattatttaaaatgaatggatttggctgggcgtgatggctcacacctgtaatcccagcactttgggatgctaaggcaggcggtttgcttgaggccaggagatcaagaccagcctggccaacatggcaaaacccttgtctctactaaaaatacaaaaattagctgggcgtggtggcacmtcctgtaatccagctactca

SEQ ID NO: 17683 - DNA, 160 bp, Homo sapiens
aaagcggctagaacggaggggagggggatgagcaatgagggaataatccccattccgtctggaatcagagggcgggcctgccgcggaggcatctgggaaacggagttcccaggtaggcgaccaggggccgtcagaagtcagcggcgcctgcgcgggcgct

SEQ ID NO: 17684 - DNA, 139 bp, Homo sapiens
aaagcggctagaacggaggggagggggatgagcaatgagggaataatccccattccgtctggaatcagagggcgggcctgccgcggaggcatctgggaaacggattcccaggtaggcgavsaggggccgtcagaagtca

SEQ ID NO: 17685 - DNA, 410 bp, Homo sapiens
  misc_feature 405: n=a, g, c or t
cccatttccccgggtcctttgatcacgcgcctgacggcttttccggggcccgggagccaaccgagggcgttcctgtcggggctgcagcggcgggagggagcccagtggaggckccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgcatcacctgctccccatgtacagstatgacccagstgaggaactgcatgaggctgagcaggagctgctctctgacatgggagancccaa

SEQ ID NO: 17686 - DNA, 220 bp, Homo sapiens
atttccggggcccgggagccaaccgagggcgttcctgtcggggctgcagcggcgggaggtaatgtatgtacagaagaaaaagcgggtggaccggctgcgcatcacctgctccccatgtasagctatgacccagctgaggaactgcatgaggstgagcaggagctgctctctgacatgggagascccaaggtggtacatggstggsagagtggctaccagc

SEQ ID NO: 17687 - DNA, 382 bp, Homo sapiens
  misc_feature 333: n=a, g, c or t
tccggggcccgggagccaaccgagggcgttcctgtcggggctgcagcggcgggagggagcccagtggaggcgccctcccgaagcgscactgcccatgctgaccacccagccctscggctgctgatgtcatgagtaacaccactgtgcccaatgccccccaggccaacagcgactccatrgtgggctatgtgttggggcccttsttcctcatcaccctggtcggggtggtggtggstgtgggtggaccggstgcgccatcacctgctccccatgtacagctatgacccagctgaggaactgcatgaggctgagcaggagctgstctmtgacatnggagaccccaaggtggtacatggstggcagagtggctaccagcacaagc

SEQ ID NO: 17688 - DNA, 491 bp, Homo sapiens
ttggacaagacgaggaggcgcactcagagtcagagaccccggggcagagacaggggcaagaagaaggggccaccgagaccccaagagagtcagggagacagacgcaccaaacgaccgacacaaccagggacaggttcaagcaattctcctgcctcagcctcgcgagtagctgggattacagatatccttcgagttggatttcgactgggttctgccagtgggatgtatccatgcgagattctggaactaacatcagagagagtccaagcttctaacttttatcagcggcagtgacaatagtcaagcagcattgatgacaaacggcaagagtttagaaagtaccagtgacgtgcctgatagaatctcaccacaagatggaagccaactcgtcagaagcctggaaagcccacccagcgtgggacctctgtgggtccaggatcttggaatggtatcccatggttcaatcttctggattcaaccacataaattta

SEQ ID NO: 17689 - DNA, 476 bp, Homo sapiens
attaagccaggtggtttcagtgcagtattgaactcaagacttttaggacacccaaagcctctgccacttttatttttatttgtttgtttgtgagacagagtctcgctctgtcgccaggctggagtgcagtggcgcgatctcggttcactgcaatctccgcctcccgggttcaagcgattcccctgccttagcctcccgagtagctgggactacaggctcgcgccaccacgcccagctaattttttatgttttagtagagacggggtttcaccatgttgtctgggatggtctcgatctcctgacctcgtgatccgcccgcctcggcctcccaaagtgctgggattacaggcgtgacaccgcgcccggcccagttttatattttaccgaggcactgccactcttagattttcacgtagttttaaaagactcaactttctcagactgttaggaataatacatttgttgatgtcgactag

SEQ ID NO: 17690 - DNA, 439 bp, Homo sapiens
ttcaaaatcaacgcttattaccattcctaaaatcctagggcccttaagaattatgttaaatataccctgcctgtgcagtatgagtggaataacaaagccaggatgacggtacatgtgtttgcagcatgggttactgtacattttaagcccactgttgagacctactgctcagaaaaaaaagattcctttcaaaatattgctgctcaattcagtgctttttcttggttgataaaaaacaaacaactaaaatattactcctggctgggcttggtggctcacgtctataatcccggtactttgggaggccgaggcaggtggatcacctgaggtcaggagttcaagaacagcctggccaacatggtgaaaccctgtctccactaaaaatagaaaaaattagccgggcatggtggcgcatgctgtaatcccagctgctcgggag

SEQ ID NO: 17691 - DNA, 348 bp, Homo sapiens
  misc_feature 325: n=a, g, c or t
caaaaatcgtaggactctgaagactgatgctaaacctgctgtgtctgagctctataaatggaacaacaaagcctcgctggcagcacatctgtttgcggcatggtttactgtatattttaagcccactgttgagacctactgcttgggaaaaaaaaaattcctttcaaaatactacwagctgattgacaatacaccatgttacccaagagctctgctggagatgtgcgaagagattagcattgttttcgcgcctgctaccacgacatccagccgaagcccatggatcaaggcgtcattgtgactttcaaatctaactatttaagantacatttcaggctgggggagggg

SEQ ID NO: 17692 - DNA, 447 bp, Homo sapiens
cgctgggattataggcgcccgccaccacgcccggctactttttgtaatttttagtagagatggggtttcgccgtgttggccaggctgatcttgaactcctgacctcagatgatgcacccgccttrrmctcccaaagtgctgggattacaggtgtgagccacctcgcccggccgacaaaagtgtgtatttgaatttagcaaaatcatctaaaggaagcaatatgtgttcttctaagttttaaaaaccaacaaaatgggtccagagtacatgtaccgtttgagatttgacttaccagtgagtatatgagatgactcataggagctaggattagaaaggtagtgttggccaggttgtggaaatgccgtggagtagaactgaattttagtcttcaggcatggtcactgttggcattttctgagccaggagtgatagcatcagagctgggct

SEQ ID NO: 17693 - DNA, 446 bp, Homo sapiens
gagacagtcacgttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacaggctggagtgcaatggcacgacctcggctcaccacaacctccacctcccgggttcaagcgattgtccggcctcagctcctgagtagctgggattacagggactatgtcacc

SEQ ID NO: 17694 - DNA, 386 bp, Homo sapiens
accctttgccgccgccttagcccgggacccgaacccagcctctcccctacccgaacaccggccccggctccaccgaggcccgggtcccccagccgtctcgccgccgccatggcggaccctaaatacgccgaccttcccggcattgccaggaatgagccagatgtttatgaaactagcgacctacctgaggatgatcaagcggagttcgatgcggactggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagag

SEQ ID NO: 17695 - DNA, 428 bp, Homo sapiens
gaagcacggaatgtgtctcctgctgggggccacgggcgtcgggaagacgtgctggtgaaacggctgcaggaggtgagctcccgggatgggaaaggcgacctgggggagcgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgt

SEQ ID NO: 17696 - DNA, 59 bp, Homo sapiens
gwagcacggaatgtgtctcctgctgggggccacgggcgtcgggaagastgactggtgaa

SEQ ID NO: 17697 - DNA, 249 bp, Homo sapiens
tgcagtactggccgcggcgcgtkggcggcggctgggctgcctcggggtcttcgacggccgcgttgggttttgtttcagttttcwwgtgtggcgytgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgcagccttgtgctgcagcgcc

SEQ ID NO: 17698 - DNA, 245 bp, Homo sapiens
tgcagtactggccgcggcgcgtyggcggcggctgggctgcctcggggtcttcgacggccgcgttgggttttgtttcagttttcaagtgtggcgctgcagcacaaggctgcgaatctgggagtccaaaggagtgtttgcggggagggcccgaggtcgctgtgtccggggcagagcggccggttcgtcccgagtctgcgctctttcgggtccrctgctgtdtcccgggtccgctctcctcagcatga

SEQ ID NO: 17699 - DNA, 153 bp, Homo sapiens
atttcgcagtgccgatctaggtaggattcagacccaagccccatgagtccacatactgcttccactcctactttactttaaatgttttaaaaagttaattttttattaatttttttatcttgttaaccgatgaactgaagagaaaaaaaatta

SEQ ID NO: 17700 - DNA, 531 bp, Homo sapiens
caaaaagcagtcttgaataatcaaaacccttcttccagatggtctaatgtcaatttcttttctgacgcagctactgttgtgtcttcttcctcattgcctggccctggttctgaagcactcatctcccagtcatcttctgttaattgctctggggtgacatctactggtgcttaaattttgtgtaatattcacaatctctttcatgatttccttgattggctctgttgtaaatcctgtgaagtcatgcacaacatttggacatggttttctccagtaggaatttattatttggggcttgatggctttaacagatttttctgtaacaccagtggcatcatgaatggtgtaatccttcgactttcttgatgttctctctagcagggttctctctggtagttcaacaatcttttccatagagtaccatgtgtaatgagcattaaaggtccttatgaccctctgatctagagagactggattagagatgttgtgtctggggagaagtagaccaacttttcagtgttgaacttaggg

SEQ ID NO: 17701 - DNA, 232 bp, Homo sapiens
atttcgcagtgccgatctaggtaggattcagacccaagccccatgagtccacatactgcttccactcctactttactttaaatgttttaaaaagttaattttttattaatttttttatcttgttaaccgatgaactgaagagaaaaaaaattaaaatctcattttaatagagaaaaaaaaaaaaaaaaaaaaaaaaaaaaaaaaaaaaaaaaaaaaaaaaaaaaaaaaaaaw

SEQ ID NO: 17702 - DNA, 448 bp, Homo sapiens
aattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggcacattgtgacatgtgagacgaacaccggtgaggtatatcgggggaagctcattgaagcagaggacaacatgaactgccagtrgccgcaagaggaagakgacgtggaatgggacgtggaaacatctttcaaaagcgaagataatttwctaagttgaacagaactttgtcctttttwctttcaggttatctgagttcattggartrggtgcttgtgcatatatgctaggtatcwtttgccatctttctctttagatcaggggaaatgtttaarctaaataaatctggggggt

SEQ ID NO: 17703 - DNA, 387 bp, Homo sapiens
aaaactcttcatctcgcggctgtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtgcaaggcccccagtggccaacctgagtgctgcctctgccaccagcagtcgggaggagccacctgaggagcctgagcagtgcccggtcattgacagccaagccccagcggcagcctggacttggtgcccggcggbtgacctvggaggagcactcgctggagcag

SEQ ID NO: 17704 - DNA, 443 bp, Homo sapiens
ggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttgagccggggcctgatgatggccgtggggttcttcgggtgctgcggagcatgcggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggca

SEQ ID NO: 17705 - DNA, 474 bp, Homo sapiens
atagtaacaaattaatattagcaatgaacacatatatgcttactaaatgtcaagcagatttctaagcatgtttatacatattaaattgcttcacatttacaactctataaggtaaatagcagtattacgaatgagaaaaccaaggcattcggaaattaagtaacttgagtacctggaatcgagctgcgtctgccgagaagcgtctcgtgtcgaatttggcccccgcgccgagccggsraaagagatcgtggacgtccatctttacccagaaagcgccacagttctacggcgcctgcgcagactacttcccaggccccgggcagcgtcggaagagggagcttcacttccctagaaggtcagaggaagagctggatctggggaccccaggwaagctgctttgacaaccagaggsctarggtctttggggaaagttgcccagagtgaacttaccacagatgccagagactcagatac

SEQ ID NO: 17706 - DNA, 143 bp, Homo sapiens
aaccaggctactgggggaatccggcagaccagattagagctcagcaatgtttgatgagtgtcacgtgtcaagccctgggttaaaggatactttgtcctactttgtctgcaccacggtgtaagaagaggaggaagaggaggaag

SEQ ID NO: 17707 - DNA, 536 bp, Homo sapiens
atataccctgcgtggggttcactgtagtagctgcactaggtgattcttggagcgggcctgagagacaaggacatgtggatcccagtggtcgggcttcctcggcggctgaggctctccgccttggcggcgctggtcgcttttgcattttagggtctgaagcggcgacsgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttagggaaaaratctggatgggaaaactacgagtgattcactgtgacttcctttaaactag

SEQ ID NO: 17708 - DNA, 449 bp, Homo sapiens
  misc_feature 142: n=a, g, c or t
aaacgggatggggagctggaccaggtgacagctgcatggacatatgccccaggctttcctgctggggtccatccatgagcctgcaggtgccctcatggagccccagccctgccctggaagcttggctgagagcttcctggangaggagcttcggctcaatgctgagctgagccagctgcagttttcggagcctgtgggcatcatctacaatcccgtggagtatgcatgggagccacatcgcaactacgtsactcgctactgccagggccccaaggaagtactcttcctgggcatgaaccctggaccttttggcatggcccagactgkgggtgccctttggggaagtaagcatggtccgggactggttgggcattgtggggcctgtgctgacccctccccaagagcatcctaaacgaccagtgctgggactggagtgcccacagtcagaa

SEQ ID NO: 17709 - DNA, 404 bp, Homo sapiens
aaacgggatggggagctggaccaggctggagtgcaatggcgcgatctcagctcactgcagcctccgcctcccgggttcaagcgattcttctgcctcagcctcccgagtaggtgtcagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggc

SEQ ID NO: 17710 - DNA, 230 bp, Homo sapiens
agatcggtggacgtgctcgcctccactcggggccaggtctatgtcccggtttcccgcagtcgcggcaagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaaaaaaaaaaaaaaaag

SEQ ID NO: 17711 - DNA, 489 bp, Homo sapiens
attccgatccgctgcccctgagaggtgggccttgggagaggcagggcttggacgcccttcctcggggcagcggggtgcagggagagttcttctggctgtgagtcccggagtccccgaccctggcaccccttcagcaaggttctcaggcacatctgccgggggcgctgaggggacctgagatggacgggccgggagggaggctgaggtaagacctgaggctgaggtaagacctgaggctgaggtaagacacagtgctggggcctcccttgaagcccgtttgaagtgaggtccccacagctgtcagaggacacacagggtgggggctcctaggtgggaaacaggtaaacctcttgggcgcctggggctggaggctgagtggtcctgaaaagaacattcaggccaggcgcagtggctcacacctgtaatcccagcactttcgggggctgaggcgggtggatcacaaggtcaagagatcgagaccatcctggc

SEQ ID NO: 17712 - DNA, 566 bp, Homo sapiens
acgcacccagggaaagcacgaccctgcagacaccttttcagactctggcctccagaactgggggaacatccctgtttcaagccaccccactgtggttgtcccacagcagccctaggaggctggcactggcaggtgagagaaatcacctatccggtcttcaggaaatcagagaacagataaagtcacagtaaactcgattcctaaaatcctaccaccaccatagccctgggaagatgggatggaactgcagaaagtggtagtcacaggtcaataagaattgacctgcaaagccacaaggtaaggttaggagtgccctggagaccaaaccctgcccctgcatgggaagagggtcggacaccgcagcctaacagtcccatcctgaaggcctgtggacgcggcctgtttttccagctctatggagccaggctagactctcaccaacagccaaaccccaggctcctaaaagaatgaggaaaactgcagaggtgcyttttagcttttgtctctaagattaatcaaacattgagcggcatataaaaatctaatctctgaataatgtcttcaat

SEQ ID NO: 17713 - DNA, 220 bp, Homo sapiens
  misc_feature 122: n=a, g, c or t
ttttctccctcctagagcctggttgcagccacttgtgcgatcccggaccttgccgcggccgcctggctcctttccgcgccatgagccgcaggttcacggtcacctcgctgccccccgcaggnhhwgccagaagccctgacccagagtcccggccggcattcggtcgcagaccccgccacctcccgggggaaagacgtcaaagcaaatccaactgatcccc

SEQ ID NO: 17714 - DNA, 483 bp, Homo sapiens
acacgttattcttttcatttgtgcctgtacccagggagatgggaagggtaggcataaccaaccagtgtccttacaaagggtggcactgaggcaagaagaagtgatttgcctgtccagtgtcccaggcaggaagcaggctctccctcctcagtatgctagccattccttggacaagtgaagtgagcacctgctaagcaaggttttagtgctgcggctgtgacagcaaaaccaagtctttctgcttgtggagctgtccatctagacggggtgacggaaacagtaagtgatgcttaccatgaagaaacataaatgaggatgaggagagggaaagagattttagaaagagtggtcagagaaggcctctcaaaaggcatgagttaaagagatggaataacaggggctttgagtaatgcaaagaatgcctagggcagagggaagagcagcgtggagactgctaagcaagatcctgcctgccttgttgag

SEQ ID NO: 17715 - DNA, 223 bp, Homo sapiens
  misc_feature 208: n=a, g, c or t
tcttccggtggcggasggcggattagccttcgcggggcaaaatggagctcgaggccatgagcagatataccagcccagtgaacccagctgtcttcccccatctgaccgtggtgcttttgrccattggcatgttcttcaccgcctggttcttcgtgtatcctttcactgagcagccagaggaccagcattagtgatgtgggaagctcanggataaacccacgct

SEQ ID NO: 17716 - DNA, 536 bp, Homo sapiens
  misc_feature 300,454,457: n=a, g, c or t
tcttccggtggcggagggcggattagccttcgcggggcaaaatggagctcgaggccatgagcagatataccagcccagtgaacccagctgtcttcccccatctgaccgtggtgcttttgrccattggcatgttcttcaccgcctggttcttcgtgtatcctttcactgagcagccagaggaccagcattagtgatgtgggaagctcagggagaaaccacgctagattgccgtgggctgggctctctgcactccacagtccaccccttcctttgccttaactgctgtgcccagttacgagntcacctctaccaagtacactcgtgadddkctataaagagctcctcatctccttagtggcctcactcttcatgggctttggagtcctcttcctgctgctctgggttggcatctacgtgtgagcacccaagggtaacaaccagatggcttcmctgngsnytgcttttgtaaattacttttttttactgttgctggaagtgtccacctgctgctcataataaatgcagatgtatagcaa

SEQ ID NO: 17717 - DNA, 440 bp, Homo sapiens
tcctgtcgacgtgttcttccggtggcggacgggcggattagccttcgcgggggcaaaatggagctcgaggccatgatgcagatataccagcccagtgaacccagctgtcttcccccatctgaccgtggtgcttttggccatttggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaaggggtaacaagccagatggcttcactgaaacctgcttttgtaaaattactttttttttactgttgctggaaagtggtcccacctgctgctcataataaatgcagatgtatagcaaaaaaaaaaaaaaaaaggc

SEQ ID NO: 17718 - DNA, 528 bp, Homo sapiens
ggattagccttcgcggggcaaaatggtgagagcgttgaggggagttccagacggagatgcgaggacccctcgggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgcctaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgctcctagtgaccaccgtctgacgcgcatctagctctgggatgatgtctattcatctttgtatt

SEQ ID NO: 17719 - DNA, 473 bp, Homo sapiens
ttttccactatggcttccagcactgtcccggtgagcgctgctggctcggctaatgaaactcccgaaataccggacaacgtgggagattkgcttcggggcgtctamcgctttgccactgataggaatgacttccggagarcttgatactaaatttgggactctttgctgcgggagtttggctggccaggaacttgagtgacattgacctcatggcacctcagccaggggtgtagccaagtagctaacacagagttcctcttcgaagaaaccttaagaaaatatgttcccggccgggcgtccgccgccccatctgggaagtaaggagcccctctgcctggccgccgccccgtctgggaagtgaggagtgcctctgcgcgactgctgtgcaaccatccaagtatgaagtgacagccttgtgtgttatctttctgtcctccccaagtttgcattttcgacattaaagtttacttttt

SEQ ID NO: 17720 - DNA, 265 bp, Homo sapiens
ctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaaaaaaaaaaaaaaaaa

SEQ ID NO: 17721 - DNA, 448 bp, Homo sapiens
aagcctggtttatatccatctacaaggtttgcgaacccatgttgccgatttttttttctgctacagaacaactcccttggtacaataaaaaagacgagtatttacttttcattgaaagtggagaacctgaaaaggaacctggaaagaagcagctggaaaagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttg

SEQ ID NO: 17722 - DNA, 398 bp, Homo sapiens
cacatcctccacctctcttggtccagcgagcgttgccgggccagggtcaagcggagggctccgacggcgcggacggagcgaasccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaagactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggc

SEQ ID NO: 17723 - DNA, 405 bp, Homo sapiens
acttccgctgacgtcggaggtcagaggttacagacaagatgtcggcggatggtagcttcgagcccttgcggagaggagcatctctgtgacagaagcttgtcgacggcggcttctaggagctagtcgaaggagcgaggttgaggcgggcagcgacccgtcagtcgctcacctgggcaccggccagctgcgagacgtgacttggggaccgcrgggaagtggagartgtkargtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaa

SEQ ID NO: 17724 - DNA, 499 bp, Homo sapiens
tcttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaagctgctgcagcggctttgaagaagaaaggatgggaggtggtggagtcggacctctatgccatgaacttcaatccccatcatttccagaaaaggacatcaca

SEQ ID NO: 17725 - DNA, 497 bp, Homo sapiens
ttcatttttgtttatgttgtctaaaaattacattgtagtgtgtctaaatattacattgtagtgtttctaaagagtgctttgaaactcagtgatttgatttattttttgtttaaaaatagttttgttttcttgttttactgcactgtgaacacagaatgtggcctataacacatctgcttccaaaactttttaaaaagcttttagtgtggcctagaacatgtccattttttgtaattgtttcacgaacaagatgaagatatcttctctgtccgtagaactgaaaactttatgtgcctgttagttaactcagtatcgtcaattatattgttcagattcatgtgttatctaattttggcctattatattcattaaaaaccaataaggttatgtgaaactttgttagtacaattgtttttgctaataaatttttataatctttgctttatgtactcaacagctgtgtaattcgaggcatataagtgcagcattgttatgtc

SEQ ID NO: 17726 - DNA, 60 bp, Homo sapiens
acgccacgggacagccaagctagaagcctgaggagccggagagggtgctggctgccgcgc

SEQ ID NO: 17727 - DNA, 406 bp, Homo sapiens
atgctcgccaggataccccctcttcccatggcgacctcagaccgcgggcgtcasgttggcgatggtctccggagacggcttcctcgtttccaggcctgaagcgattcatctaggacctcggcaggcggtgcgaccaagcgttcgggscgagagccgtcgagtggatggtggcggccggagcccaagggaaccagatggccggggccggagccgccaagcgagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaa

SEQ ID NO: 17728 - DNA, 490 bp, Homo sapiens
acaataccgtctccaccccacagatccaagagctcctgtctccccaggagccccccaggcctcccgaggcakkagaacagcagcccggattcagggaagcagctggtgcactacacagcgcascgctgttccctrctggaccccsggctccgtggacaccgggagcaacgacctgccggtgctgtttgagctgggagagggctcctacttctccgaagggacggcttcgcsgaggaccccaccatctccctgctgacaggctcggagcctcccaaagccaaggaccccactgtctccwtagaggccccggaggagctgggcccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgcctt

SEQ ID NO: 17729 - DNA, 492 bp, Homo sapiens
  misc_feature 42: n=a, g, c or t
tcagcccctcggtgaccgtgcccgacatgagsstgcctgtancttgacagcagcctggccagtatccaagagctcctgtctccccaggagccccccaggcctcccgaggcagagaacagcagcccggattcagggaagcagctggtgcactacacagcgcascgctgttcctgctggaccccggctccgtggacaccgggagcaacgacctgccggtgctgtttgagctgggagagggctcctacttctccgaagggacggcttcgcgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcgtcttgggcactggtgggtcggccgccatagccccagtaggacaaacgggctcgggtctgggcagcacctctggtca

SEQ ID NO: 17730 - DNA, 322 bp, Homo sapiens
acaataccgtctccaccccacagatccaagagctcctgtctccccaggagccccccaggcctcccgaggcagagaacagcagcccggattcagggaagcagctggtgcactacacagcgcmscgctgttcctgctggaccccggctccgtggacaccgggagcaacgacctgccggtgctgtttgagctgggagagggctcctacttctccgaagggacggcttcgsaggaccccaccatctccctgctgacaagctcggagcctcccaaagccaaggaccccactgtctcctagaggccccgggagagctgggccagccgc

SEQ ID NO: 17731 - DNA, 438 bp, Homo sapiens
tacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcccggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctt

SEQ ID NO: 17732 - DNA, 500 bp, Homo sapiens
ttttccactatggcttccagcactgtcccggtgagcgctgctggctcggctaatgaaactcccgaaataccggacaacgttggagattggcttcggggcgtctaccgctttgccactgataggaatgacttccggagaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcaggggggtgatt

SEQ ID NO: 17733 - DNA, 129 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaa

SEQ ID NO: 17734 - DNA, 486 bp, Homo sapiens
acaacagtatagaaaaccaattagggaagggtaggtatatgtaaaataggtgaagggtgaggatcaatcagaagaaagccaccaaatgggaaaagagactctcaatccagaacgtggatttgactcatagcttggcttccaggctttaaactgtctcggcttgaagggctcaggttcaaggacaattgcctgaaagagacctcttctgatctcaccttgttcacaacggtattctggaccagatataaacatatttttcttggccgaaagtgttatgttttacagatctctttgatactattctgctcaagccagcagacctctattcttcctgattggaaaatatcctatatgacatcttgcaaatggcaggtacagacattctgaacacctgtgtgctcactattgcttacttgaataacctttgagccatgatttttctctctgaatgatgacagctccaagattccatgaaagaccttcctg

SEQ ID NO: 17735 - DNA, 499 bp, Homo sapiens
aacaccatgttcactctagggtgaagatttaacatttgaatgtattacaattaggccttataaatcaaaaggtaaagcagaggacataaaagccctctgtgctcagtctccgtagaatggccagaaccattctgtggttggtggtctctaatcaggaaggaatgctgttctggaatttgccatttcacttctctgaggatcttcatttcgtagagtgaagaatggtatttagaagtcaagatctggaaactagactaggaaactgaaaattagagcaagaaaagcagtaaaccaagaaaagaagcctgcacaataccagcatctgaaaggacaagtgaaggaagaaaaaccaattagaggatacatcagaacaatgcattctccactctccccctctgaagattcagaattaagagaaatttggagatgaagatcacctgagtgtcctcattttactaatgatgaactaggcctaccaagccatctaatcatcctgagg

SEQ ID NO: 17736 - DNA, 68 bp, Homo sapiens
agggtcattagctgttgagcctccccgggcgggcccaagcctttggatctcaggtgaccggcacaggc

SEQ ID NO: 17737 - DNA, 382 bp, Homo sapiens
aaaaattaaacctcaccgacggattcaattctctcgttctcaggccgtcttcatcgccggagcgttttcttacgaaaagaatgggcttctggacattgttaaaaggtctgctgctctttgcaaatgcactggcaatcctcaacgaagaccgtttccttgttccaagaggatggacactcggagaactccaccaaaccggtagaagaaactctcccaaaggscaaatcattggtctgatccatgcctgccagtacatgaggctacccctcatgctcattaacacagcagtcatcgtcttgaagcttatctccggttgaagatwttgtgtagatgaasataaactacattgcgttcttcaaatgattgtgattagttacaaatc

SEQ ID NO: 17738 - DNA, 512 bp, Homo sapiens
taaatgtgataggaatgaagaagttggtactcactgactctaataactaacagtcccagggttgactgatgtagctggatccaagggtttgctcatccaaactcactctctgagatacccctagcaacacttggccttcactggcctggcttacgttcatcctaaaaccacaatgacctgggatatgcagggctctaactggccatgtctgggccccttgtctggctcagtggtaaaactgcctcttaggggcttgagattaggtgatggggcagttgttttcaattcaggagctactgccaaaagaggggtaaaatagatactgatcaatagtcttgggtcattgatttttattcccatttacttgttgatgaaaccagttcagttgtcccataggaagtcctaccttctggatttgtctgataattttcctttggcgctatttgacttgttcttctttcttctgtatttcctaaaactggaattgtgtatgacagcktgataatatacag

SEQ ID NO: 17739 - DNA, 516 bp, Homo sapiens
aaccattagtccatcgctgcccttttccattaaacattatctgccttcttagattgttttatttttttaaacaggataggtaatgcaacagagaattaacggtgcaactaacaatgaaaacgcatttgaggttcccgaatcagtgaaggctttgcaaaggctctttgcttacccattaaactagtgaactccacaagattgtgatgatgatggcaacatagttcttagatttctccaaatctccacattaaagaaaaaaaaagtcatagcaactagacacccaaaccatgaactccaacattcaagtggttggggaaaactttttgacaacttcgagacctgcctataattggcatctctgcaggagaaagcagagggggatggaaatcttctggaattttttttagtggggatggaaatcttctggacagtggtgatggttagacaactctgtgaatacactgaggatcactgaactgcacacttttaggatgatgaattttatgaaattttcaa

SEQ ID NO: 17740 - DNA, 491 bp, Homo sapiens
gattttgagtcccatccactgcccttgacacaaaaatgtgcatctccttatccccaccgtgaattccaagttctaacatctgatcaagcaagaccaccattttccctttttctttcacagcgcaggcaatgtcagtaatccaggaaattccgcaaattttacctccccagaattgacctaccaattattacccatgacttgcctcctagtccaagcatgatctgggtacttttgaggattagtggagtaatcaaccaacccaccccaatccttggtggccagactctaccagagctgaaggcagtttgaaagacagctgtgtgaaaagaatgtgttgcccaggaccactggacaagcgcctgcgagtggacatggtgggttttggttttcttaggtggacttgttcggggctttataaccatagaatggtgaacacttggaaaatactatgaaaggattaaaagttttatcgaagtaaaaaaaaaaaaaaa

SEQ ID NO: 17741 - DNA, 362 bp, Homo sapiens
agtctgtaggtgactgcagaaggaggaggagctccatctgttctctcttcaggcagttgttgtgtgtctcagtgcttgttgggttcacaacctattaaataagccggctggtcttcaccctcccagacaagtcaactcaggggagtcagcagggcacgggccttggcccaasccccagctgggccatgcctgggctgtgaagtgggcaggcgagcagcaggcaagaccatctctgcaagtgcagcatagcctcagcctagggcagcgggagtgtgtggcccaagctgtgagcaaaggcacagatggtgaaaggagtagaggcaccccatgggaaacatactgacctgttgtgtgtgccccag

SEQ ID NO: 17742 - DNA, 502 bp, Homo sapiens
attctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaagaaccttcaggatccagctttctcctcgggcacgggggaggctcggcggacctgctgattggggaaccgatatggc

SEQ ID NO: 17743 - DNA, 102 bp, Homo sapiens
gtgaagcgcacaccgacggggacgagagcgcagaggatggcgcttttagatacttccagtcttccgatgttgtgatcgcagtgtgagtgaagacactcagga

SEQ ID NO: 17744 - DNA, 149 bp, Homo sapiens
aggagtaggtttttgataaaagaattgccacctcccatcccagaaagctcaatgatggaacactaaaagcaccttcctgaagttatggctttctggcacacacaacrdatkatatagcattraaatgacctccttctaaaaagcaaaaa

SEQ ID NO: 17745 - DNA, 432 bp, Homo sapiens
taacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagtcaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggcttggccgcacatggaagtgtgccttcatggaga

SEQ ID NO: 17746 - DNA, 459 bp, Homo sapiens
tataaagtgtttatttctggcatttttaatacttttggaccatggttgactgagggtaactgaaaccaaggaaagcaaaaccacagataaggggtgactactgtgtgcaccatttttattcattctgccatgtgcttatttatcttgtttttaaacagctctattgagatataatttatatactatacaattcacttaacatgtacatttcagtagcttttagtgtatttacaaatgtgtgcaaccatcaccgtggtcaattttaaaacattttcatcaccctcagaaagaaaccctgaggtggaagcaactcaagtgtctatcaacaggtggataaagaaaatgtggtatgtacatacagtggcttgagccaggagtttgagattgcagtgagctatgattgcaccactgcactccaccctgggcgacagagcaagacgttgtctcagggggaaaaaa

SEQ ID NO: 17747 - DNA, 97 bp, Homo sapiens
gtctggagcttcacattctctgccccccacccaccgcgccggcgctcccttgtcacgcctcgggaagcgcgcacctgccaagcagacaaggtcactc

SEQ ID NO: 17748 - DNA, 401 bp, Homo sapiens
tatgtctgtattgttgtagattaacactttatttatctaatgagattatgtacattaattatgctttaactacagttaacccttgaataatacagcagctaaaggcactggctcccatgcaatcgaaaacctcaactctccccactggctgaggcaggtggattgcttgaagccaggagtttgagaccagcctggggaacctaatgagaccctgtctctataaaaacttctcagaaattacccagacatgatggtatgtgtagttccagctacttgggagactgagatgggaggatcgcttgagcccaggagtttgaggtttcagtgagctgtggtcatgccactgcactccctcctgggtgatacatcaagaccttgtctccaaaaaaaaaaaaaaaaag

SEQ ID NO: 17749 - DNA, 462 bp, Homo sapiens
agatacccccggagctccagccgcgcgatcgcttycccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagac

SEQ ID NO: 17750 - DNA, 410 bp, Homo sapiens
atggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacscatgcacacggaccctgactactcagctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctat

SEQ ID NO: 17751 - DNA, 495 bp, Homo sapiens
attgccagattccggggggtctcccagcccattgctgcagcatcctgtgcgtgacctggatctgttacttcactaggagttacaaagtagtgactttccaaatgttatccttctttccacgtttatgagctccagttcttcttgaaaaagctctaaagcacatgcctttatcatctgtgtggttaccctagcatgcggcctgcagagggaaggctcagaggttccattcctccctttatcagggatcagaatgagctggtgccctgaggtttgtggctgtgtgtgtgccgagaggacggagaacaggccagcccagatccacacctctcagtgaaccaaaagtgaccctgccccctttgcaggccccgcgtgcctactggtcccagcctgttgtctgccccagcttgcctttctacgtggaaacttgcccagtgcaatctcactgatttttgaaaatatatttgatgcgtttcagtccaaaaaaaaaaaaaaatg

SEQ ID NO: 17752 - DNA, 131 bp, Homo sapiens
aggcggctctcgtggaggcagctagcgcgaggctggggagcgctgagccgcgcgtcgtgccctgcgctgcccagactagcgaacaatacagtcaggatggctaaaggtgaccccaagaaaccaaagggcaa

SEQ ID NO: 17753 - DNA, 477 bp, Homo sapiens
agagccattttcaaatgtcccccttcctctaggcaagaaaaaaaaagaagataagggaaagacaaaggaaggaaatggaaggaaaggacaaagaagaaaagtctactctgaatcttgacatgtcagcttgattctagaagtgcgtttacctggaggacttacccacaactttaaccttgatgcttgcatgtgcctctccagcttcgtttttcagattgatgtggtaaacaccagagtcatctctttcagctatatcaatgaccagagtgctgctatcaggtcttcaacaaaccagaagactcattaggatccataatagctgccagtgtagaggagcctcagttactttcmtttgatcattatccctgggagaagaagccaacagctcctggtgaccacaataagagatttcatttttacctcttacgaarrctcagtggaacatttctcatcaccggctgkcacataatactctga

SEQ ID NO: 17754 - DNA, 488 bp, Homo sapiens
acttcccggtggagtgaggaacccagcaacacgctcctgacttcccttcccaaggactcgacctgagaaccgcctactcggagatccagagggagcgggcagacattgggggcctgatggccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcgctgcagtgcccctttgagcaggagctgctgagacggcagcagaggctgaaccagctggaaaaaccaccagagaaggaagaggatcacgcccccgagtttattaaagtcagggaaaacctgcggagaattgcsacactgaccagcga

SEQ ID NO: 17755 - DNA, 475 bp, Homo sapiens
  misc_feature 279: n=a, g, c or t
acttcccggtggagtgaggaacccagcaacacgctcctgacttcccttcccaaggactcgacctcgagaaccgcctactcggagatccagagggagcgggcagacattgggggcctgatggccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtngtcctagagcaccgccggsggaaccagctcatcaagaagaagaaggasggagctggaagccaagcggctgcagtgcscctttgagcaggagctgctgagacggcagcagaggctgaaccagctggaaaaaaccaccagagaaggaagaggatcacgcccccgagtttattaaagtcagggaaacctgcggagaatt

SEQ ID NO: 17756 - DNA, 380 bp, Homo sapiens
attttcaaatgtcatccctttctagttatggcaaataagaaaccaagaaacacaacaggattttgtcataagtcctctaggcaagaaaaaaaaagaagataagggaaagacaaaggaaggaaatggaaggaaaggacaaagaagaaaagtctactctgaatcttgacatgtcagcttgattctagaagtgcgtttacctggaggacttacccacaactttaaccttgatgcttgcatgtgcctctccagcttcgtttttcagattgatgtggtaaacaccagagtcatctctttcagctatatcaatgaccagagtgctgctatcaggaaaaactaggtgaatgcagaaaattgcatccagctgaaatgacccagcaagg

SEQ ID NO: 17757 - DNA, 399 bp, Homo sapiens
ccagcccttccaggcagcctgctgcccagttgaatgaaggagtctgctctcagagtatctgctgtgggagagccccggaccccaagcatcttcaaargtctaataattaatggggctgtccagctgaagctgacatccgcacgcagccctcccagagctctgcacctcagccagcccacggcctccaccgtctggccctgtcggctgagtggtrcccagcaagaaaacatactctcctcaggccagatttcatagtgaaaatgagaagcagagacgaaatggctcagccgccatgtactcggagatccagagggagcgggcagacattgggggcctgatggccggccagaatacagagagtggaatccggagctcatcaagcccaagaagctgctgaac

SEQ ID NO: 17758 - DNA, 517 bp, Homo sapiens
atattgttaatggctcgctataaactaccttacaacttgagtttctactccattcttactggacttttttcaatcctttaattttttagtttttgttccagtcaaagtttttagttgcatgaaacagaaactaactctgcctgatttaagtaggaaaagaatttgctgagaggctattgagtagctcacaaaatcatggagcagcaggctcagaaacagtatttttgagcagtggctccgaaggcaccgtcttcttcaagaagtttatccggaagccaatgcacccattggacataaccgggaatcctacatggttccttttataccactgtacagaaacggtgatttctttatttcatccaaagatctgggctatgactatagctatctacaagattcaggagtcaaattctgaagatctttaaagtcatagtcatggcaaccatgggaagagcagtcgaatcagaaagaagaaaaaaaaaaggttttgagacatgactctatcaactgactgtaa

SEQ ID NO: 17759 - DNA, 236 bp, Homo sapiens
  misc_feature 96: n=a, g, c or t
aggtgagccgtggctcagggtccggagcgcggtcgggacacagcgcctctaggagaaagcctggaagsgctccgggggtaccagagctcttagcgngccggcagcatgtgcggggcccaaggtcttccgggctctgcgtgggggtcgctgcggctggagaccagggagggggatggaaacggggttggaaagtaatcccacccgagcagtaaatggaaatgttttctaacatataa

SEQ ID NO: 17760 - DNA, 495 bp, Homo sapiens
gacatctttacccactttaactgaagttcccacaataatctcatcatgaggctcactcgttctcacctccagagttctggggggtaaaataatacataaatgcaaggattatcttatatatacaccaagggaaaggaaatactgcctattaagaattagcagctaacagctgggcgcggtggctcacacctgtaatcccagcactttgggaggccaaggcaggcggatcacaagatcaggagttcgagaccatgctggctaacaagcatcaagcaaagaacttgtaatacgctgaatgctgcatagaaggttttgaaactacttacctgctgtggaacacctgtataactttaaaatgcatcaatcaatctcgagagtatgatcatgcttcctgcttttaaggatctgaagttactgcwactccawgtatacaagacttctttgggacccattgaaccatctctmaatgctcatgtttgcaaaatcaattggctc

SEQ ID NO: 17761 - DNA, 522 bp, Homo sapiens
agagctggaggttctgatcagcaaataaggaaggaacaacatctgacatctttacccactttaactcatcaagcaaagaacttgtaatacgctgaatgctgcatagaaggttttgaaactacttacctgctgtggaacacctgtataactttaaaatgcatcaatcaatctcgagagkattgatcatgcttcctgcttttaaggatctgaagttaactgmaactccaagtatacaagacttctttgggacccatggaagcatctctacatgctcatgtttgccagattcagtggcctcctgaaacctggccctagctaataagttaaaaagctctaagtaatcccgagctgcatttgaatctccaagatcacttgttcatgggttggtaatactttaaagagccatttgtttaactgctaatctggatcttatattctgagccccagcttttttctaaagcaaagaaaatacaaaataaaagtaagaccaaatgcctttgtaccatggaaaaaaaaaaaaaa

SEQ ID NO: 17762 - DNA, 384 bp, Homo sapiens
acccactgtgkaactgtgagtatatgaaatctaggcaacaaaataaatagadhagagactggwwgacgtgwtgsttcctgggagaacatgtgccccatcaagcaaagaacttgtaatacgctgaatgctgcatagaaggtkttgaaackrcttacctgctgtggaacacctgtatdractttaaaatgcatcaatcaatctcgagagtatgatcatgcttcctgcttttaaggatctgaagttaactgcaactccaagtatacaagacttctttgggacccatggaagcatctctacatgctcatktttgccagattcagtggcctcctgaaacctggccctagcttaatwagttaaaaagctctaagtaatcccgagctgcat

SEQ ID NO: 17763 - DNA, 490 bp, Homo sapiens
acccactttaactgtgagtatatgaaatctaggcaacaaaataaatagaacagagactggaagacgtgatgcttcctgggagaacatgtgccccatcaagcaaagaacttgtaatacgctgaatgctgcatagaaggttttgaaactacttacctgctgtggaacacctgtataactttaaaatgcatcaatcaatctcgagagtatgatcatgcttcctgcttttaaggatctgaagttaactgcaactccaagtatacaagacttctttgggacccatggaagcatctctacatgctcatgtttgccagattcagtggcctcctgaaacctggccctagctaataagttaaaaagctctaagtaatcccgagctgcatttgaatctccaagatcacttgttcatgggttggtaatactttaaagagccatttgtttaactgctaatctggatcttatattctgagccccagcttttttctaaagcaaa

SEQ ID NO: 17764 - DNA, 501 bp, Homo sapiens
tgaaagtgtaagaggggtgctgaatggggggaacagaacttctgaggcaacttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggastgctgcagcacctcagccctggcctgcatgcttttaggaactatgagcagattgtgaaggcacaccaggacaacccccattgaaggggaggaccaggtctctgacaggtcaagttcaacgtgtttcaaggcatcatggattccctgttccagtccttt

SEQ ID NO: 17765 - DNA, 505 bp, Homo sapiens
cccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgacgataa

SEQ ID NO: 17766 - DNA, 430 bp, Homo sapiens
aawttawtggktttymatttttgtwaaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagc

SEQ ID NO: 17767 - DNA, 298 bp, Homo sapiens
atataccttagaccctcagtcatgccagtgcctgckctgtgcctgctctgggccctggcaatggtgacccggcctgcctcagckgcccccatggcggcccagaactggcacagcatgaggagctgaccctgctcttccatgggaccctgcagctgggccaggccctcaacgatggaggaggatattctgcagctgcaggcagaggccacagctgaggtgctgggggaggtggcccaggcacagaaggtgctacgggacagcgtgcagsgctagaagtccagctgaggagcgcctggct

SEQ ID NO: 17768 - DNA, 431 bp, Homo sapiens
  misc_feature 377: n=a, g, c or t
agtgtcagctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtgggcctttcttcacgcccgccatccgccaggccccgagggactcgaagtgtcgtttcggggccgctgtctacgggggaggaggtggcggtgcgcctggcctcgtgggatacgtgatggtgacagaagagaagaaggtgtcgatggggaagccagaccccttgcgggattccgggactgacgaccaagaggaggagcgctggagcgngacttcgaccgcttcattggagccactgccaacttcagccgctttcascctgtg

SEQ ID NO: 17769 - DNA, 510 bp, Homo sapiens
agttctctcttttggtcgctggcgcctgtttcctcagagccactttttcctttgtgttgtctggtcgttcactactttgagggaaaagaattttgccgttcgcgttcgattgactccgtccccaagatcctgtagccccacggacctggcgactccaccgtgttcgggtctttctaggaacccaatctgccttcatgaagaaaagacagaggcagaaaggaagatggcttactgcctgacaaattgttatcaggtatgcagaaaatgtatacttccacaaaatgacatacttgcatcaccaggtaaacacatttccttctaggcagatgtgtctccagagcttctttaagtaaataaagactcactcaagcactgagtcacttgttgaatttccccagggagtggaggttctcatactgataatccttgaaaagcatttcagcatttcagtaattgttaattaattttgtcccttatggtgcagatatatatttcttattttgctgagtg

SEQ ID NO: 17770 - DNA, 491 bp, Homo sapiens
aaggtggatcccagaggctcagactggggaagaaagttatgccatgtagaagtaaatttaatgaggccctgcatgccttcctgcagccctgtttttcccacgttcggccctgtacagcctgatctgtggaatgggggtggaacgtgcggaggctgagcaagcgctgaccacctgccagcaccgtgctgagctcccaatgtacacggattgaaccagaaatggccggggatcacccacttcacacccacaaaaccaccaacttcatatggtgcagcctgactaccacatttaatttctcagcaatcttgagaggtataaggattacatctccacttttcagatgaggagaataagtcatcactccaaatcaaacattagtgaacaacagagtgagaatttaagttctgagcccggactccaagccctattcaaaactattacatgacaccgataaatccttttatactaacctgtaaacaatcaattacagc

SEQ ID NO: 17771 - DNA, 455 bp, Homo sapiens
tcccacgcggtctctgggctggttgagctgcgccgctgcaggtagtgctgagttgctccaggtaagctcctcctctcaaaaagctctaggaaccgagccaccctcgccctaggagcaacgcccctgagtaatatggggtttcgtcggatttctgcccgccgctctggatcacacgtttgttctccctatttgagtcgcaaggccttccttcattccacctagcaggctgcttggaaaagggcagagactcattactttgcaccagattggagaggatgaagtccctgaggtccaagaacatggaaacctgacagtggacgccaacagctgtggagagaagccgggcgacagctgtggagagaagccgggcgatatgctcacgcttccgtgtgcccagcaatcctgctttatctttttaaataaaggtgattcctgacaaaaaaaaaaaaaaaaag

SEQ ID NO: 17772 - DNA, 418 bp, Homo sapiens
aagckgccgcagagcgscaaagttcgcaggtctggggctctcttcccagagagctcgtaggggaggacagtcaagggactcaagcgtctctcttgactccccttctctcgctgtgcaktggcggcgcgaggggtcgacgctcagggctaatctctatgagtcaccctcgaggccccgggtaatattgggtggatcacaagaactaatctttcatgatttggaaaccggaaggaaagaagcacttttgtagctgacttacctcaatgacatgaccagtgtctgagcctacaactgcgctatcttccctggatttttcttcacsttttcgttactcatgagccagactactctctgagctcctaccatkgggcagcactgtgctggttgcaaaggatgcttggagaacctgaccagccct

SEQ ID NO: 17773 - DNA, 486 bp, Homo sapiens
attttattttgctttgttctgcacttgaagggagcaggcacaaggctgccagaagagctcagctactttaggctgtgctgtttggaacgagggatgttaagcagaaaggcccaggctggtgggggactgggaggctgccttccagcccatccctgctgcttgaccttggatgcgtcattggtggtggaacataggttcaactatctttaaaatcaaggctgggccggcgcggtggctcacgcctggaatcctaggactttgggaggcggaggcgggcggatcacctgaggttgggagttcaagtccagcttggccaacatggtgaaacctgcctctgcggaaaatacaaaaattagctgggcgtggtggtgcgtgcctgtagtcccagctattcgggaggtgaaagcaggagaaccacgtgaatcagggaggcagaggttgtagtaagccgagattgtctcactgggcaatagcacgagactctgt

SEQ ID NO: 17774 - DNA, 413 bp, Homo sapiens
cctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgcaaaaaaaaaaaaaaaaaa

SEQ ID NO: 17775 - DNA, 414 bp, Homo sapiens
aaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcggcccatcccacgcccctgatacgtccgacgtcggggccacgctgcttgtgtctgacgggacccacagtgtccgatgcctggtgacgcgggaggccctggacacctcggactgaaggagttcggcttccgcgggacagagggccggctgctgctgctgcaggactgcggggttcatgtccaggtcgctgagggcggcgcgccgcagagttctatctccag

SEQ ID NO: 17776 - DNA, 285 bp, Homo sapiens
atgctgccacggggactgaagatggcgccgcgaggtgagattccggagtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgtaccaaaaaaaaaaaaaaaaaggc

SEQ ID NO: 17777 - DNA, 123 bp, Homo sapiens
attccacgcagagggaaccgcttgtgcaaaggccccaagactgcaagaacatcctgaagagggtagaagagaggtctgagcgggagtgcactgctttggatgctcacaaggagctggaaatgg

SEQ ID NO: 17778 - DNA, 458 bp, Homo sapiens
cttgaagatttgtctcctgtgtttttctgaaagttttaaaccttcacagttgcagatttatgtccgtgtttattttggtgaattactgtatgtggctggcatttacatgaagctcattgtctggcaccatttgtggatcttccatggagttgcttctgtgcctccctcagaaatcatctcgatgggctgggcgtggtagcccaggcctgtaatcccagcactttgggaggccaaggcacctgaagccaggagttcgagaccaacctgggcaacatagtgaaaccccgtctctactaaaaatacaaaaattagccgggcgtggtgacgcacgtctgtagtcccagctactggggagactgaggcaggagaatcgcttgaacctgggaggcggaggctacagtcaactgagattgtgccactgcactccagcctgggtgacagagcgagactccgtccca

SEQ ID NO: 17779 - DNA, 498 bp, Homo sapiens
tagcagccaggtcaggctgggcatggtagcataggagatggtggtcctgaggtctaggcttctcaggtaaactgaagggtagccctgacctgtgtggacacacagtgggtcataatgaggtagctaaacggttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagccatttcatctg

SEQ ID NO: 17780 - DNA, 446 bp, Homo sapiens
acttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagccccgcgccccaccgcgcgtcctacaarscggtcatcgtgktgcatgggctcttcgacagctcgtacagcttccgcmacctgctggaatacatcaatgagacacaccccgggactgtggtgacagtgctcgatctcttcgatgggagagagagcttgcgacccctgtggaacaggtgcaagggttccgagaggctgtggtccccatcatggcaaaggcccctcaaggggtgcatctcatctgctactcgcaggggggccttgtgtgccgggctctgctt

SEQ ID NO: 17781 - DNA, 348 bp, Homo sapiens
aattataaggcagttcatagatgctgctgctgctgctgctagcatttcatctgctgagaatcacactcagtagcaacagccgtccaagatacagccctgcgggctttgagtgttaacgttgggtgcatagtgatgaggcttttttaaagccttgaaacggggccaactggtaatacctaaggaacatttcctggcaacagaaaaagctctcttggtctttaaagttcatgacagattccctaagtgtttgtaaaacatctgccaaccacactgatgggctctcacacaaaggttttggaaatacagactgatttcctttggttactaaaactgatttttttttttttt

SEQ ID NO: 17782 - DNA, 392 bp, Homo sapiens
actccagttctcggaggaatgctttcaacttttctgcattcagtgtgatgttgtctatgggtttgttatatatggcttttattattttgaggaatacatccagatggcctgaagcaagtgaagaatcacaaaagaagtgaaaatggccggttcctgccataactgatgacattaccttgtgaaattccttcttctggctcagaagctccccaactgagcaccttgtgacccccacccctgcccaccagggaacaaccgcctttgactgtaattttccactacctacccaaatcctataaaatggccccacccctatctcccttccctgactctcttttcggactcagcctgcctgcacccaggtgattaaaaagttttattcctcaaaaaaa

SEQ ID NO: 17783 - DNA, 469 bp, Homo sapiens
aacggattagaaggacttttaaagatgtgtgaggaaagagctcaccgctgaagaaggctgctgcatcactgaacttcttatcactaacatagcgagattttagtttggacgaatttgaggttataggggagatagcgatrgcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgamgtcagggttcccgccggcttcgagcctttcttggcgtatttgtatcttgagctgatttctgcgtcasccacatctcgctctgatccgcacaccccccggttgttttgcagtagcagtctcagccctcttctcgtctcatycccaaatcgtaatttcagttcacagctttttatctata

SEQ ID NO: 17784 - DNA, 212 bp, Homo sapiens
ctcggccgccaagctccgcctcccgccccgggctgtgccggggtcgcctgaggccgaccacccgcaccccacctctagcggctttgctcgaggcccaccttcttcccacccccggcaaactccagtaggctcgccctcgctgactccccacccctcaaggaaatgtgtcaaaattgtattaaaataagacaacgtgtgatgagaaaaaaaaa

SEQ ID NO: 17785 - DNA, 481 bp, Homo sapiens
attaaactgcttgaactgcttgggttgaacccaactctgccacttactggctgcgcaacattgaccaagttatttaatgtcccagtgtctcagttccctcttttgtatataggcataataataatcatacctatacttcacagagtgttgtggaaattaaataagtacatatatagaaagtgcttcacagggacaggcgcacacagtaagtgctgtgttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagcaatctgcgaaatatcaaccatcagttagagaagctccttgaccag

SEQ ID NO: 17786 - DNA, 441 bp, Homo sapiens
aataaccggccgccgccgccaccgcggaccgagcgcggagttctggagtctcggacccgaagccgccacagggcgccccgcctcccgcccgccatgcccgcgccccgcgccccgcgcgctctggcggccgccgcagcccgcgtccgggaaggccaagctgacgcacccggggaaggcgatcctggcasgcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctycctgctctacggttccatccccaaggcggccgtttcagatttggaatgttcgagttcctcagcaaccacatgcgggatgcc

SEQ ID NO: 17787 - DNA, 483 bp, Homo sapiens
tctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaatgaagaaggagtgattgaatgtcgggcaaggcactggctgagctgctgtggctccctagcctaaggggcctgctgtccctctgaggcctagtgaaaaagctgcaggaggtgcatcctccasctctaatcttggaggctattatcttacctccaagcactgagctgggttactgcccaattccatccttccctgaaggagagaagggaagtgaaaagtagagt

SEQ ID NO: 17788 - DNA, 433 bp, Homo sapiens
  misc_feature 137,428: n=a, g, c or t
aaaaacccagcgaaactccgcggagccgcgcggcacgatggacggtcgggtgcagctgatgaaggccctcctggccgggcccctccggcccgcggcgcgtcgctggaggaacccgattccctttcccgagacgtttnacggagataccgaccgactcccggagttcatcgtgcagacgaactcctacatgttcgtggacgagaacacgttctccaacgacgccctgaagacctacgctaccactgccatcgccatccaccgmatctcaccaacagactgtggctcctagtgatgtggactcacctcggaggtatccgagctggacacagcccctggacagtgatccagacagctggccgtcccccaaggagcctgtcaccttcagcgagacccatttcctcsccatccccagagacctcttgtgttcntggca

SEQ ID NO: 17789 - DNA, 553 bp, Homo sapiens
tgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 17790 - DNA, 424 bp, Homo sapiens
ggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccamctgsgamawggggttccgaagctwatgcctccaccaaggagagctacccgcacgtcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaa

SEQ ID NO: 17791 - DNA, 501 bp, Homo sapiens
gccacgaaggatttcccgtgccgtgggagcgggttcaggaccgctggtcggacctgagagtcccagctgtgggaagctcagctgtgtaatttgtagtaacgaagcagaagttacaacgaaaagacaagttttcctgtgcttggcagggcccccctcccccccaccraggcctgcagtggatagagcctagcagatcctggacaatactatcctaaaagctacatctctgacagtgatttccagcgactttgtcaacacggtccgcccccagcaagtataagaggaaaaacaacaaatgtctttactgccttgtctttcccccttgccacttgtcattattcaagttttgtaagttcctgatttccattcagtgcagctgcaaggttaccagctgtgcttgcgttgcaagacctgtcacagtttgattaactgccttctttctgcttctgtaagccctcttgcctgccccgcgagtttcacaccatcaaattcctgctgcac

SEQ ID NO: 17792 - DNA, 383 bp, Homo sapiens
ttgtagatgaggcagcgcaggggctgctgcttcgccacgaaggatttcccgtgccgtgggagcgggttcaggaccgctggtcggacctgagagtcccagctgtgtgtgagggctaggagggctgggggtggttggggattggctggagtggtgctggggcaagtgactgtgcgtttaaagggtgaggcgtatggagctgtggcgggcggagataggtgcaatcttatttatgtggcagggcagatattatggttactgaaatgccttttaaacccgactcaactatttcatttcaagtgtgctgttctgkcattttctccaaggtgggaagctcagctgtgtaatttgtagtaacgaagcagaagttacaacgaraagacaag

SEQ ID NO: 17793 - DNA, 517 bp, Homo sapiens
caaatggattttgttttttaagtgaaagcaagtttattaggaaagtaaaggaataaagaatggctactccctaggcagagcagcctcaaatgggtttttaatctctaaaaagactaaaaaccactgtccttccaccttaaacattattttaatctcagcagatgaacagagtacctgttctgcagagaaaatataaatcttacgtgtgagttgttagggatttccttcaaggtattaaaacaacagatcggctgggcgcggtggctcatgcctgtagtcccagcactttgggaggccgaggcgggtggatcgtgaggtcaggagatcgrgaccatcctggccggcatggtgagaccccatctctactaaaaatacaaaagttggccaggcacagtggtgggcactgtggtcccagctacttgggaggctgaggcaggagaatcacttgaacccaagaggcggaggttgcagtgtgccgaggtcgtgcactgtactctagtctgggcgacagagcaag

SEQ ID NO: 17794 - DNA, 253 bp, Homo sapiens
tgacgttattttgttcaagctgggatacagtaggcaggtctgagttcatttctgagactgcctgccaaatatcaatccctttatggcaagtgatcaaatttccttgattttttcttttttttaatatatatgtttttttattatacttgaagttctagggtacatgtgcacaacatgtaggtttgttacatatgtatacatgtgccatgttggcgtgctgcacccgttaactcgtcctttacattaggtatat

SEQ ID NO: 17795 - DNA, 419 bp, Homo sapiens
aaggaagcggatagcgtggagtgacggtvccaccgcggcgcarrrgrrksyksmawcssmgwgsrgrrrrgrsrrrmmssrgwgygmgmarkwrsykggkkggsmrcatggctgggatcaccaccatcgaggcrgtgaagcgcaagatccaggttctgcagcascaggcagatgatgcagaggagygagctgagcrcctccagygagaagytgagggaraaaggygggccygggaacagcwgaggctgargtggcctccktgaacsgtagatccagctggttgaagargagctggactgtgctcaggagcgcctggccactgccctgcaaaagctggaagaagcgggaaaagctgctgatgagagtgagagagatacaaaggttattgaaatctgggccttaaaagatgaagaagatgg

SEQ ID NO: 17796 - DNA, 364 bp, Homo sapiens
tgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgcaaaaaaaaaaaaaaaaaaggc

SEQ ID NO: 17797 - DNA, 504 bp, Homo sapiens
taaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagwatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggag

SEQ ID NO: 17798 - DNA, 50 bp, Homo sapiens
tgttttgttctggctttgaggcttgttttgttgtctgtgtctgtctgaat

SEQ ID NO: 17799 - DNA, 525 bp, Homo sapiens
accagtgaagtactagcataaaaacagacgcatggaccaatgtggaacagcgtagaaaaaccagaaataaccccatgcatatacagtcaactaatcttagttctggagactgggaagtccaaggttgagggacacttctggtaaggacttccttgctagcaggactctctgcagagccccagctattgggagagtggctgagtactgagtctatcactacttggatgatacagtgttttttctatttaacttgtctattccttatgaagcttctgtcttcaagataagcagaattgttcagaatccactggaatccaaattcaacttgggcctcaatttctgcagatggacacctctggactccaaaaaaaatccaaggacataaaaaacttaagcagcctttattacatttagttcaacaagtttaaagtgtaggtcactttccacttttgtttacttgatgcttaattttactggaatcgttaaaagaaatatacttgcaatttttttaaaaaggtaaaaaaa

SEQ ID NO: 17800 - DNA, 448 bp, Homo sapiens
acaaacctagcgccaaggttggctgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgggcctctagcgacgagagtcccgggagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatatttt

SEQ ID NO: 17801 - DNA, 506 bp, Homo sapiens
cacatttattttcctaacccctgtaaaccctgtccagaccctattagcttaatctgggtgtctgcctgacaggactagatagaatggttacctgggtgcctatttccaagagaaccataaaattttgagtctctccctgaacttctctgggcaaacctcctagtatgtctggccttcagtccatcttggggatcagggagacctcagccccattcctaaccatcttgctcattaaagcagaagagtttgggggtaggagcagagagggatcagggagtgtggagggggagagagcaacttggtgctggtaatcaaggctttatattcactttgggtcattctctcgcagtttaatgtttctggtctacttgaagctctgtagttggcagcaaggtcatcattacttacaccatttcttttagtttaggggattccttggctcagcagtcacagccacagcctttcatgtgggacatggggcttgttgccttattgttatgatactc

SEQ ID NO: 17802 - DNA, 459 bp, Homo sapiens
  misc_feature 406,433: n=a, g, c or t
tttccgtgcacatataagccatagttrcagtacaggtggcagtatttagagcactcagatttcagttctgttaaatgtgaaakagggatcgactgacgttcattgctgttcbataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaaaatctctctgttagcccatggattaagtgttggttcatagagattgccaataatcrgaaagaaccttaaatktgcatttaanacattktcccttcccttcttttcaatnaaggtccctgcctatataaatcatct

SEQ ID NO: 17803 - DNA, 413 bp, Homo sapiens
atctcctatccgctccgggcgctgccgccggaagggccagcgacggagggtctcagatggcggggcttgaggcccacccgggctctcgggtcggcgagtcccgttggggagcccttgtgcctgctaggatatttagcagatgccaggcggccagaaacgtcctcacttttctccctcggccctctggggaaccgccgtgagcgtttcccacggacacaaacttaacaggcccagaacgtccagggaggacgcgttgtgagcctcaaagagcccacttacgtgaccgacagcaccaggccgacgggcactcgctgaactgctggcccggagcagcacagctcttaagtgggcagtggcatcttttatacaaataaaggaaggtggccccacgtcccgaaaaaaaaaaaaaaatg

SEQ ID NO: 17804 - DNA, 477 bp, Homo sapiens
ctgattttattgcatgggatccaggtatatggcttgataagcagttctttggcatttgctgagactgtgattctgcttaataataatgtaaatcctattgtcactcaatagagaatttttacacacatacacacacacacacccagatcaagcctgttaacaatgtgttcaaatctatccttcatcatttttgtctgcccaatgaatcaatttctgaaagaagatgttaacatatttcactataactgtagacttgtcaacttttatagatcaagttcttagctaagtttaacaaatgtctgttgaatgaaaataaactcaaagcaaaatttgttttccttccattggtcccttatattactcaatacagaactacatgcacaaaaaatatttgaatcctagttgatttaagaaatgttttcaagagcagcaagctatatgatcaccaacacaacacacttactacaaaaggtgtag

SEQ ID NO: 17805 - DNA, 426 bp, Homo sapiens
  misc_feature 411: n=a, g, c or t
taataaatattggaatactggcttttgtgtatttttttgtgttacttagtttttggagaaaggaaatatttctagactttcttgacttgtcataactttttattgttaaagaatatagtttaaaaattattaaatattagggagccttctgcttcattgggactttaaggaatgatagccataggaagggatatatcttatattatcataaagcttttaaaaaataatatatttattacaattttttaaatttattttttatttttagaaacagggtcttactctattgcccaggctggtctcaaacttctgggctcaagtgattctcctgcattgacctcccaaagtgttgggattacaggcatgagccaatgagctcagccagttgttttttttttttttttttttttnsragggktttttttt

SEQ ID NO: 17806 - DNA, 365 bp, Homo sapiens
attctgtctggtgtactggtaatatctggactggtttaatggcttgtttcatgggagaagcgctaaactttacctcaacatttatgtaaagataaagctgcacagattctgagtcttgaaagtttatttcaaagaaaagacaatgcctgtgccacatatttgacttggttttataaatattacgaagctccaggaaatatgagcaggatctcaaatatattcaacaagcttccaatttttgtcttttgagatggttgctcttggaacacagaaatatgctttaagatgtcaagcctcctctgctgatgctgtatggagaacagacaagctttcccatcaagccctaaccaaactgcagaactgtg

SEQ ID NO: 17807 - DNA, 314 bp, Homo sapiens
ccatccctccctggtagctaggtcccgatatactcctgtcttgtgagattgtcgagatgagatgggggacactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatctttaaaaaaaaaaaaaaa

SEQ ID NO: 17808 - DNA, 432 bp, Homo sapiens
actttgtttattcytttgtctgtattaatggacttttgactcttttttcccccttgatagtaggtcacattttcctgcttcatttcataaatacaaaatttttgttgtagagtggatatgatacatcatatctctaaactctttttatcttcccttgatgaatgttaaaattagtggctgattatattgaatttttggaaccttggtcttctgttttaagatgggtctatagaaagtctgaggcgttggccaggcgtggtggctcatgcttgtaatcccagcactttggatggccaaagtgggtggatcacttgaggtgtcaagagtttgagaccagcctggccaacatggcaaaaccctgtctctacaaaaatacaaagatgagccggtgtgatggcaggcgctgtaatcccagctgcttgggtggctgag

SEQ ID NO: 17809 - DNA, 441 bp, Homo sapiens
  misc_feature 402: n=a, g, c or t
agaaaggcctctcaggaaggcaacagtgcatggcgactctttaccccttcgcccgcctcctgatctacgtactcgcctattcctgcgtttactcgtgtttgtacatgttggtttactttcttcgcatttttgtagaggattaggcagccaagctggaccaaagtcaccagggtggtgaaggcccggcccaccgccgaaatctgcagtcttttaattctgcactttctgcccccgctccccgcacttgactttccagaaatggccaatttctttcaaatgctgtatactggaaaaatccaaaggactcatcagatgaacacatttcaaagagccactaccaattttttttcttaagcaaagcatcaagcctctgatttsccgctgataaattctctgtgtcanacactgctccaggccaggaacacaagaaggaaagtagac

SEQ ID NO: 17810 - DNA, 374 bp, Homo sapiens
agttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgtaagactttgttaattctttgctgcttctatttgaaacctagagccacacttagggaagggtaaatttccaaatatc

SEQ ID NO: 17811 - DNA, 435 bp, Homo sapiens
agagtggagcggccgccggagatgcctgacgcatctgtctgaggagcggtcagtgacgcgatggagcgggcaaggagacagggtctggctatgttgcccaggttggagtgcagtgatgcagttatagctccctgtaacctcaaactcctggatcaatctagactcctgcctcagcctcccaagtgcctgttagtacaggcttgagggatcgcttacacctgagacgaactacagaacagcacgtaccagaggtggaagtccaagtcaaacgcagaaggactgcctcactgagcaaccaagagtgtcagttgtaagcgatccctcaagcctgtggtcccagctactcgggaggctgaggcaggagaatcgcttgaacctgggaggcacaggttgcggtgagctgagatggcgccactgcgstccagcccgggcaac

SEQ ID NO: 17812 - DNA, 404 bp, Homo sapiens
araaagcacgttttgcataacttctagatacatgtacttctattttgaakgasctggtatatctttktkctttacaattctcaacctcagcatatgtaagtbbractcagaaggcaacattccctgaacatactcttccaccagaatctcctctacagakttkkgctgccccttttaccagtggctgaatctactttctcttatggatcgcttacacctgagacgaactacagaacagcacgtaccagaggtggaagtccaagtcaaacgcagaaggactgcctcactgagcaaccaagagtagtgacttgtcaggaggatcaatatgaaggacggcctaaacatctccctgcaaatgctttagcagcatctccctcccctcamccctggggagaaaggattgt

SEQ ID NO: 17813 - DNA, 434 bp, Homo sapiens
acagtctgtggagacagttgtgtccctgtggctttggtgcgcctgtgtgcactttctccctccacctggagcatgggctaacaccggagaaaggaaaagacagagtcagacaggggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtcccacattagagcctct

SEQ ID NO: 17814 - DNA, 481 bp, Homo sapiens
acagtctgtggagacaggtgagcgacgaacttctgagacagggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggatagccaaactggaacagaggcgaatggcctcagaggggtccatggcccaggaaggaagccctggaagagctccaatcaaccttcggcttcggggaccacgggctgtgtccactgctcctgatctgcagagcttggcgcagtccccacattagagcctctgactccaccccctgcctatgatgtctgctttggtcaccctgatgatgatagtgttttttatgaggacaactgggcaccccttaaatgactctcccaagatttctcttctctccacaccag

SEQ ID NO: 17815 - DNA, 573 bp, Homo sapiens
attttatccagatcctattcaagatagagtcactggttcaaaggcctctgacaaggggacagaaccacttgtggccaagtcctcccaaatgcaacaaccagtggacaggagagtggagagaggcctggagtgaatgttaatggaatttcctccatgttgaaggaagcataaggctgcagtgcaatggcataatctcggctcaccacaacctccgcctcccaggttcaagtgattctcctgcttcagcctcccgagtagctgggattacaggcgtgccctaccgcacccggctaattttgcatttttattagagacggagtttctccatgttggacaggctggtttcgaactcccaacctcagataggattctggttttcgttcaagatagtgtccctgacactagaatcataagctcttggtgaagaattacttaagcagatcctggattctagtggaacaactaacaccaaccagtttaaagacccccacagaggwaccaaatcagcaagagaataccgtttcttcatctccctgccccatgacttcaccccacaattttcaaccaatcagt

SEQ ID NO: 17816 - DNA, 384 bp, Homo sapiens
attttatccagatcctattcaagatagagtcactggttcaaaggcctctgacaaggggacagaaccacttgtgccaagtcctcccaaatgcaacaaccagtggacaggagagtggagagaggcctggagtgaatgttaatggaatttcctccatgttgaaggaagcataaggctgcagtgcaatggcataatctcggctcaccacaacctccgcctcccaggttcaagtgattctcctgcttcagcctcccgagtagctgggattacaggcgtgccctaccgcacccggctaattttgcatttttattagagacggagtttctccatgttggacaggctggtttcgaactcccaacctcagataggattctggtttthcgttca

SEQ ID NO: 17817 - DNA, 495 bp, Homo sapiens
cttttttctcgttccccggccatcttagcggctgctgttggttgggggccgtcccgctcctaaggcaggaagatggtggccgcaaagaagacggtgagtgaggcgggccaggcccggaagacgattcacgtggagagatgttttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaaacagact

SEQ ID NO: 17818 - DNA, 296 bp, Homo sapiens
cctkgctcgttccccggccatcttagcggctgctgttggttgggggccgtcccgctcctaaggcaggaagatggtggccgcaaagaagacgaaaaagtcgctggagtcggatcaaactctaggctccaactcgttatgaaaagtgggaagtacgtcctggggtacaagcagactctkaagatgatcagacaaggcaaagcgaaattggtcattytcgctawacaactgcccagctttkaggaaatctgaaatagagttactatgctatgttggctaaaactggtgtycatcactam

SEQ ID NO: 17819 - DNA, 355 bp, Homo sapiens
aacctcaaggagccctgttgtgctaccgactgcagagctcatggacatccatcaggaagcctccaatacccaaaccaggggtagttgcctaatccatatccatgtggatagctctttacttaggaaaccttgatggcttatttggatgacaaaggttcccttttggcgatacatagccatgcgagacaacatagccatgaaacaaaccaagtccaccagtggcttcctaggaacacatttgctttcctgataaaagaggacagatgcagttgcagaagtacctgtgcctctttttctttttcttcttctttttcttttttaatctcttaaatgcagatataagaactgggtactg

SEQ ID NO: 17820 - DNA, 542 bp, Homo sapiens
aacgacgagtttcagaacgatggcagagctcccgcgtgagrgctgctgcccctcctgggcgccgcctgctgctgatgctacctctgttgggtacccgtgcccaggaggacgccgagctccagccccgagccctggacatctactctgccgtggatgatgcctcccacgagaaggagctgatacgaagcgctgcaagaagtcttgaagaagctcaagagtaaacgtgttcccatctatgagaaagaagtatggccaagtccccatgtgttgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctgctttccccagaggacccacaccttcctcccctggagtttggctttaagcaacagataaagtttttattttcctctgaagggaaagggctcttttcctgctgtttcaaaaataaaagaacacattagatg

SEQ ID NO: 17821 - DNA, 269 bp, Homo sapiens
  misc_feature 84,216: n=a, g, c or t
agtcgtggactcgtgcagctggggcgtccgcagccgctcgtcacccgcgtgatgctgtttctggcgttgggcagcccgtggcgntcgaactgcctctctgcggaaggaggactgcattgtgtgcggccgccgcgctccgaggtccccgggcctctgtctcccgggcgtcctccagsagcgggysttcggggmgggtagccggctggagtacgggmncttcgggagccgcgcgccttctccggcgtccgggtcgagcgcagatccctgtt

SEQ ID NO: 17822 - DNA, 204 bp, Homo sapiens
gttctgggctggccttttcctctcccaggtgcgcttccctgcttgatctgtgtaccctgctctttctccttcattccgcagcctcctttgccctgtgacctgcaggtactggacggtccctagagaggataccgggacgctcctgaagccgcgagatgatttcaagcagatgcagccbtgaccattagggccaacggccaaatt

SEQ ID NO: 17823 - DNA, 449 bp, Homo sapiens
gagtaatcccggaaggacagggagagaggggtggccgtgggtggggtggggtggggtggaagggaccacatccagcaggctgagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctsgtattttcaaacccagatttgctatgcggggctgtgctacagagagtatgtgctttaccaagcctggtgct

SEQ ID NO: 17824 - DNA, 211 bp, Homo sapiens
  misc_feature 120,133,136: n=a, g, c or t
agtagctggtagtggaaggaggagctctgactacactctcacgactgttttttgcctcttggttcttgttatgtccctttctttttgaaataagacagaaggtccccaccttcatagacnatagagagayccnaynttatttgtttttaaaaataaattgaaaagtgagaaacamaaaaaaaaaaaaaaaaaaaagaraaaaaaaaaaaaa

SEQ ID NO: 17825 - DNA, 282 bp, Homo sapiens
tttcagatcttagtgaagcctgaatcctgaaatgtgttttgtagaagtactttattacatatatgaaataaactataaagaaggtagtttttaaaaaaaatttcaaatcaaataatttgtatgttttccatgtttaaattatctaaagttattcaatctcctgagcctaacagcaatgtagaaacggramtttttgscttttccaaaagatctggaaagcatgaagactgggctttttttcctatgtctcttgggaactgcagctgcaatcccgacaaatgc

SEQ ID NO: 17826 - DNA, 193 bp, Homo sapiens
agtagctggtagtggaaggaggagctctgactacactctcacgactgttttttgcctcttggttcttgttatgtccctttctttttgaaataagacagaaggtccccaccttcatagacatagagagatcccatcttatttgtttttaaaaataaattgaaaagtgagaaaaaaaaaaaaaaaaaaaaaaaaa

SEQ ID NO: 17827 - DNA, 444 bp, Homo sapiens
agtccgcggcgccacaagcctcagtgtttacttctgccgcctgccagccgggcggggaaggggagtacccggccacccctcactttagctcctcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggsccsggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagg

SEQ ID NO: 17828 - DNA, 329 bp, Homo sapiens
attataaagggcgccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcrgaagcgggcsaggagcagcccatggagacsacgggcgccaccgagaacggacatgaggccg

SEQ ID NO: 17829 - DNA, 464 bp, Homo sapiens
aactgaaacgtttcctaaccatacatagggatgatactcagatttgtttagatgttgaatgtgaagctaacatttttaaacagcttaaaattgtatcataaaataattttaagttacagtttgttttgagttgcctataaaaatgaatttttaagctaatttgttaagaatttggttatcgggccaggcgtggtggctcatgcctatataatcccagcrctttgggaggacgaggcggggggatcacctgaggtcgagaccagcctgaccaacatggrgaarccccgtctctactaaaaatrcaaaattagctggaagtggtggtgtgtgtctgtaatttcagctacttgggaggctgaggcaggagaatcacttgaacctaggaggcagaggttgcagtgagctgagatcgtgccattgcattccagcctgggcatcaagagtgaaactccatctgaaaaaaa

SEQ ID NO: 17830 - DNA, 394 bp, Homo sapiens
  misc_feature 54,122: n=a, g, c or t
aggattttattagcttctctcccccaggccgcagccaatcagcgcgcgtgcccnggcccctgcgtctcttgcgtcaagacggccgtgctgagcgaatgcaggcgacttgcgagctgggagcnatttaaaacgctttggattcccccggcctgggtggggagagcgagctgggtgccccctagattccccgcccccgcacctcatgagccgaccctcggctccatggagccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcgga

SEQ ID NO: 17831 - DNA, 388 bp, Homo sapiens
caacggctttatcgtaggagcgtcttcgcctcccccgtttccagtagaaaagacagctttgctcctttgaaagcgcagaccgccgcacctccagccccttctccccggggaagtaggccccgctaagaatgtgggaaggtggtggggcggcgactgaagtcgttccgattggcgttgtcccaaggaagcctgcgcggattatcggcggcaggcctccaatagagcctgctaggcggattggctgctacgcggctgggccctgtttccggtacctaggcgggcagccatggtgaccggcgagcggcatgcgacgcgcctctgtggcctgtggaggcccgcttggcgaagctgcttcccgacctastggtctttcggaagcctcggggat

SEQ ID NO: 17832 - DNA, 396 bp, Homo sapiens
ataaaatgactaggtgcattttgactagttcaattttgttctgggacacatgtgcagaacatgcaggtttgttacgttgctcctgttgttgagtcataatacaattttgcctgcagtgtgagctcttgtcatgggaagcaggcaatcgcgatgaaaagatctggctaaatatctgtgaaaagattgtcattttggacagaggtacctgacaaagttggattagatggaacgtggggcaagcccaaatgagagcaagtcatttgctttaatcctgtgtatgaacctacagaaggctcagtctcatgaccgatctacacataaaggaggcctctccaaaccagtagaagaaaggttggtgaacctaactgagcgttaaaccactgcagaaaaggaaaa

SEQ ID NO: 17833 - DNA, 445 bp, Homo sapiens
  misc_feature 54: n=a, g, c or t
tacgccacggcgtctgctggcggccgcggagacgcagagtcttgagcagcgcgncaggcaccatgttcctgactgcgctcctctggsgcggccgcattcccggccgtcagtggatcgggaagcaccggcggccgcggttcgtgtcgttgcgcgccaagcagaacatgatccgccgcctggagatcgaggcggagaaccattactggctgagacatgccctacatgacccgggagcaggagcgcggccacgccsgttggcgcaggagggaggccttcgaggcataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaact

SEQ ID NO: 17834 - DNA, 515 bp, Homo sapiens
attctctctaatgactgtctccctcgctggatgtgatgaagtaggctacattatgcagcaccccattgaaacaaagaattgagtgtgaccaccaggcaacatctggcaaggaactgagttccaacagtgcacaaggaagtgaatcctgacaacagtcccaagagctttaggagtgaatccttctccactccagcctcagataagtcttgcccttaattgcagcctcatgaaagactctgaaaccttgggcccaggtaacccatgccaagattcctgacctgcagaaactgtgggtcatcaagcatgttctttcaagtctctacatgtgtagtaatttgttatgcagctttagataaccaagagatggaacaatttggaactgccctacagttacggtggggcataaaatgacacaagcattttggaaaacagttgggcagtttcttataaaattaaacagacacttaccctaacacccagcattgtgctctaggtatttacctaagaaaaataaa

SEQ ID NO: 17835 - DNA, 453 bp, Homo sapiens
cgtgatagagtggagggagatggcccagtgactgaggccagctgtgctctcctcagctgtatagccaaaggccagtgcatcctggtttgatttaggtaaagcctagtcagagtgcaaaagacagtactcaaaaggaacagctctgagaaattcagtctgccaacatgggtagatccaagatgtgaccacagggagtaggaccctgttctgagggctggctggagctaggcagagtgctggaggtgggctgggagaaggatgaaagtcttgcagagcatcagtggctgatgcaggacggagattagagcatagagggcaggtaagagggcccaaggtaagaacgagagccaacgggcacaagcattctatatataagtggctcattaggtgtttattttgttctatttaagaatttgttttattaaattaatataaaaatctttgtaaatccca

SEQ ID NO: 17836 - DNA, 377 bp, Homo sapiens
atacaagatcaggaagtgttcttatttgtagtaagttcattctattcaaattaggtatcctttggaataggaaacgttttcagccattgtacattattgaacttttattttgtctaccgtgtacaaagtacctgtgagatggggatacaaagacattttccaaattttgggctccagtcgattcttgtgtattacgctgtgagcaagacttgcatgtcgtcacagagaacggggcactatccctgataaagattgtgggagttggcttcctacagcatcgatcacatggctttaacccacgagcaagatggctgaagctgaagaatgggctggatcacaaaaatagattttctgtctgaggtttaaaaaaaaaaaaa

SEQ ID NO: 17837 - DNA, 308 bp, Homo sapiens
catatttattggcggattagttgttcattgtctgtcttccccacaaggatgtctacttcatgagggcagcttcctaagtcctcagtgatcaactgattgcctgaatgaatgaatgagtggtgaggacagaatggggggtaaaaagctgggagaggcaggtacagtggctcacacctgtagtcccagcactttatgaggctaaggctggtggatcgcttgagcccaggagttgaagaccaccctgggcaaccccctttctacttgttatcatggcgaaaccccatctctacaaaaaaaaaaaaaaaaag

SEQ ID NO: 17838 - DNA, 451 bp, Homo sapiens
cttttgcccagcacacctgtcactcacctcaaccctttctctcttttccccatctttctgtggctagctcctcctcattctttaggtctcagtgtagatagcaccactatcaggaaggagtccagacactgccaggcctaagatgagtaaatggaggctcagagacactaaatgacctaaccaaggtcactagcatgtaaagtactagtgcccagactctgatctgagtccttggacttcaattcctgtaactcccacactgccatcatttgcctgacccttggtatagcaccaaggggttctacacaaagaagagtggatgcacttggagtagattcacttcttcccattcctcctgctaaactaaacacagctaaagcccttggacattatatataaaactaacataaaaagacagaaaggtgcagaaaaagaagcagactgactagca

SEQ ID NO: 17839 - DNA, 381 bp, Homo sapiens
agcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcctcctcctcctccgccaactcctcggctgcacaccagctctaagagcgagagtgaacgagagagggagggagagagtgagagcgagcgagatctttggagagatttttttttttgcctcctacttctgtcttgaagccaga

SEQ ID NO: 17840 - DNA, 421 bp, Homo sapiens
  misc_feature 315,396..397: n=a, g, c or t
ctcttggataaatgcgcctggatgtctcacatccgggaactcagagtgttaaaacttgagctcattattttcccctagacaccaattattccttttttattttccgtctttattaacgaaagtgwttactgcctaagccagacactgagagccaccatgtattcctctctctctctcacctattcccatgtttaatccattatttggattggtccattttatctccattttctcaaatacaggaaaagacagatcatcatcaaccagcaattgtgactatctacatattcacataaggatttcccaacttggggnatttttgtcaagttgagaccaggcatcttggagtyagttccatcaggktactgtgactgtcatcgatagcctcggagggknnacaactcacaagagtcagcctggg

SEQ ID NO: 17841 - DNA, 416 bp, Homo sapiens
attttccgggaagatggcggcgcacaagtcaggtccggcacatgtttccgcggrsvtccccagcaatgacggatgatatcacctcttcttctctggtgagaktctgaggatagagacttttttctcaccatgaagaggagaagatgggggtcttggaggaaggaggaaaaggcaaggaggctgcaggcagtgtcaggacagaggaggtagagascagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggat

SEQ ID NO: 17842 - DNA, 428 bp, Homo sapiens
catgattatcagagtgccatggtgaaaggatgagtgacttctacatgttgaaactaaactatagctttaggtcatgtgtgggagacgggtccaagtgagtgtatatagtatttgtcctttggtatttattgttgttgttcgggttgttgcccaacctgcagttttcaggaaccgtgaggtacagccagatggacagcctgtgctttcacatgctgcagctcccccatgcttccctctccatctggagtctgatggactttgccaacactgcagcaccaggagctaatttctacctgcctctcctcagctatgttctcttgacggagcatctatttatatatcacctcatgctgcagcatccagctggttttgttgttgttgctttccatttgcagagatgttaactgcagtggtatttctttttcatt

SEQ ID NO: 17843 - DNA, 543 bp, Homo sapiens
aactaactacatgtcatcttagaacaggctgcttcatagtttatagtggaacagtttccatattctagaaaattagaaaagcttttgataaaagagaactagaaaatttgtcagtaggctatattaaaagacatccttcttggactcttactgcaataattgctttggcttttgaatatactgcattcagaagctaaatcttccctgtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacagaaagtcctacttagccaaagctgtagcaacagaagccaacaactcaacatttttttcaatatcttcctctgatcttgtttctaagtggctaggtgaagtgaaaactggttaagaatttattccaacttgccagagagaacaagccctccattatcttcattgatga

SEQ ID NO: 17844 - DNA, 432 bp, Homo sapiens
taagatgattagtagcctaaagaataaagaattttacaaattaaagcacaaccactgtcttgaagaaatgtctgttatttcctgattttcaaaagtgactcattattaataataaactgaaactaaagctccccacgttggatgagtagaaatatttggctatatgctatctgtgttccttaacatttattacatattacagtttgggtttaaaattacagttgggaagagttaagtaggacagagtgtcatatcagattttttttgagacaggatcttgmtgtgttgtccaggcttaagtgcagttgtgcagtcatggctcagttccctcagacctcctgggctcaagtaatcctcctgcctccaccwcctgagtagctgggactacagaaaagggccacaacatccagctgaattttttttttttttttt

SEQ ID NO: 17845 - DNA, 257 bp, Homo sapiens
acaccttccggagtcggcctcatcaatcatagatttcacaagtccttgcagccttacccttggcaaaagaccaggagtgttttccaagccctccaaatactcttcgggcgcacctcgcctctgcctgaaaatgtggtgacctggaagaagaactcaagaatgttactaacaatctgaaatctctggaggctgcatctgraaaaggttwtykgaaaaggaggacaattwtgaagaagaaattaaacttctgtctgaca

SEQ ID NO: 17846 - DNA, 387 bp, Homo sapiens
  misc_feature 16: n=a, g, c or t
acgcgcgggctcgcgnttcggtttccccagacctgctcgcagcaccctgctgtcttcccggtccggcccgctgcccgcgcgccasaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcct

SEQ ID NO: 17847 - DNA, 343 bp, Homo sapiens
agaactcggtcccgcctccagagcggagagccacttggcggggagggagtggcattgagctgaggcaggaggcgtgggctggcccgagaaaccggcgctgaagtctcagtttgcgttttgctcttggttatgccccactgtcccacgcctcactcgcttctgcccccgcggacagcgttcactctctgggtcttagtcttttatctcagggcagatcaggtcagcagctaggaatgaagacccttcactgacccgtccccagkcccacctcatccctgctgttgcaacatccctgctgtttcttaatcacagagtcccctaaaagacccagaatcaagaacca

SEQ ID NO: 17848 - DNA, 608 bp, Homo sapiens
aattacttctttaaacaccctatctcaaatgtagtggcattctgaggtgctgggagttaacccttcaacaaatgaatttgaggaggaagaggacacagttcagcccatagcaggaaccagaaaggataaagaaaatgatactgaaattaagaagccactcagaaaaagaaaacacaggagagaaatgtgaggagcctcaattttcatgaaagatgtccagaataatccatttaaccctctcttccacgatctcattgtgtttgtgtaactccaggccaagtatcaataacatccaagttgatttatggtggtgaaaggtttttccgtgagaactctgatgatggaagtcaataaatgastattaggaagatagaagtctctctacaaacccaaactggtggggctagtttatgtcaaaggaatgaaaaatgaggctggtctgtgaatgcctagtaccctgcgtgaaagccaagctaaaaaccagatcttgggtgaatttttattctccatcaaaaatttgcatttgtacacccactttttgtaacagattctttttatgctaactcctcaacgaagtgcttctactgcttttgaagactggacagtgt

SEQ ID NO: 17849 - DNA, 269 bp, Homo sapiens
taaagcctgttctttaaggtgtctcgttagagcccaaagtggaatccggaaggcagccagagctgaggctgccccaagactcagacttgctaagaattacgcsgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatat

SEQ ID NO: 17850 - DNA, 347 bp, Homo sapiens
aacttccgggctcggcagctagactagcgggggcagcctcagagcgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgtaggtgatattatgtcgtgactttaggagaagtaatggtgataccaaaaaaaaaaaaaaaaag

SEQ ID NO: 17851 - DNA, 355 bp, Homo sapiens
acttccgggctcggcagctagactagcgggggcagcctcagagcgggtgagcttggggacgcacggagaggtgcagctgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgtaggtgatattatgtcgtgactttaggagaagtaatgg

SEQ ID NO: 17852 - DNA, 585 bp, Homo sapiens
aatcacctacaagtacaccctcttaaaataacattctgttaacactttagtgtctgtgttctaactgtagatgtctcscgtagtgttsttagtggttmtgtagctatatgcttgaaactttaacaaattccctatttttgaacattaggttagtttttcttgtttttgcttttataaacaatactatgttgcatgtctttgtagataaatcctgatagtttcagttctaaactaatattaattggtatagaatcggccctatgttgtgttttgcattgggaaagttttattttatatcaactaggctttcatcttctgctaataactgaagtgtgaactcaaaaacagacacttagctaatccatttgagccttagttgtctcattaataaactgccttggctaggcacagtggctcaggcctgtaatcccagcactttgggaggccgaggtgggaggattacttgagctcaggagattgaaaccagcctgggcaacatagcgaaacatcatctctactaaaagtcaaaaaaattagctggatgtggtggtgtgcatctgtggtcccagctacttgggaggcaga

SEQ ID NO: 17853 - DNA, 562 bp, Homo sapiens
agttccgttcattctgaacatgtcaccggggactttggaatgtgtatccataactccctgattttcaaccacattccagcctgcctgactcatgaagcgtggagsvacccaggaacatcccagctcctcatgtcccacattcttcaggctttctcttagttttggcatgtgcatgtaaatgtcaacagtgcccagatcagcgcctgatatatacttggcacacaataaccactcttgaaattcatgaaggaatctggacatttagggggttcatcagaatccgccgcttttagggaagattctctgcctgatgtgtgagcgctctaacctcttcatctgtgttcagtccccttgcaatgcttctctaagatcaataaaggcaaaaaccaggagatcccataaatcccgctgagcctgtcatagctatcaaattakacccagataaagcttctggtggctaatgacatggccatcacccagcgtggacgtgggcakgaggggctctccgggagcatctggtctgctgtggagacacttgtcatctggaggctctgtgctctaa

SEQ ID NO: 17854 - DNA, 711 bp, Homo sapiens
agttccgttcattctgaacatgtcaccggggactttggaatgtgtatccataactccctgattttcaaccacattccagcctgcctgactcatgaagcgtggagcgacccaggaacatcccagctcctcatgtcccacattcttcaggctttctcttagttttggcatgtgcatgtaaatgtcaacagtgcccagatcagcgcctgatatatacttggcacacaataaccactcttgaaattcatgaaggaatctggacatttagggggttcatcagaatccgccgcttttagggaagattctctgcctgatgtgtgagcgctctaacctcttcatctgtgttcagtccccttgcaatgcttctctaagatcaataaaggcaaaaaccaggagatcccataaatcccgctgagcctgtcatagctatcaaattatacccagataaagcttctggtggctaatgacatggccatcacccagcgtggacgtgggcaggaggggctctccgggagcatctggtctgctgtggagacacttgtcatctggaggctctgtggctctaatggagggtgatgctttgaacgcgactwtytcccccataaaaaaataaataaataataagtataatttaaaaaaaaaaaaaaaaaaaaaaaaaaaaaaaaaaaaaaaaaaaaaaaaaaaaaaaaaaagaaaaaaaaaaaaaaatgcgaa

SEQ ID NO: 17855 - DNA, 182 bp, Homo sapiens
gacgcgtttttatttgaaaaggtgaaacatactcaacataaataatttggacagtaggaggagaatgggaagagtatacagtggcaagcaaggtccttcctcatccttatccccaaataccccttctcagaagcagcgatcactgtcaccattttcagtggtttttttttttttttttttaa

SEQ ID NO: 17856 - DNA, 436 bp, Homo sapiens
  misc_feature 405: n=a, g, c or t
aggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaacatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagaacttnaatggaagctagcagaagttggagcaataca

SEQ ID NO: 17857 - DNA, 405 bp, Homo sapiens
acgtcaacaggccggaaaggcagacagaagggaaaaggccccgcgcgtctccacgtcaacaggccggaaaggcagacagaagggaaaaggccccgcgcgtctccacgtcaacaggccggaaaggcagacagaagggaaaacgccccgcgcgtctccacgtcaacaggccggaaaggcagacagaagggaaaaggccccgcgcgtctccacgtcaacaggccggaaaggcagacagaagggaaaaggccccgcgcgtctccacgtcaacaggccggaaaggcagacagaagggaaaaggccccgcgcgtttccacgtcaacaggccggaaaggcagacagaagggaaaaggctccgcgcgtttccatgtcaacaggccggaaaggaagacagaagggaaaacgctc

SEQ ID NO: 17858 - DNA, 334 bp, Homo sapiens
aaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtactctgcgcattcttataggggaccctcctcaccatgatcatcatgatgagttttgccttatgccttgaatcttgaggttaataatcat

SEQ ID NO: 17859 - DNA, 397 bp, Homo sapiens
gttgaggaaacggaaatccagcgcacacgtgaaaacgccccggactgcggctgcgcctttaacccgcacacagacggttggcagaggaagaaagccttgtcacactaaaggagagacagcggatgttctgaacagtcctgtcgtgaaacgttagacaacgtggacgaaacaggcacattcctaagcatcacacattactgaaactcagtcaagaagaaatagaaaatctgaatacatccatggcaagcacagaaactgaactaggggattcgaaatcttcccacaaagaaaagcctaggcccaactggcctctatgctttgaagatggaagtggggacatgagccaagcagtgtgacaggctctaagaagctgggaatgtctgtcagctgacagtca

SEQ ID NO: 17860 - DNA, 307 bp, Homo sapiens
gcagagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatcaagaaaaggagcaagttgctaataaaggggagcccttggcc

SEQ ID NO: 17861 - DNA, 435 bp, Homo sapiens
  misc_feature 64: n=a, g, c or t
agagctacgcagccttcggtgcagtcgtcactcgtgtctcgctaccagctccccgctgccctgngctcggcgggctggcatccggcccgggggaaagcggaccagcccttctgcaggtctgcggggccaagtgtcccggcggcgcacctcgtggcgagaatcgggagaaggaggagactacaaggataggcccargagtaatggagtccaaagagaaacgagcagtaaacagtctcagcatggaaaatgccaaccaagaaaaatgaagaaaaggagcaagttgctaataaaggggagcccttggccctcsctttggatgctggtgaatactgtgtgcctagagggaaatcgtaggcggttccgcgttaggcagcccatcctgcagtatagatgggatatgatgcataggcttggagaaccacaggcaaggatgag

SEQ ID NO: 17862 - DNA, 414 bp, Homo sapiens
  misc_feature 105: n=a, g, c or t
atcctgatgcgatccccctcccccctccggttcatgtagggagtcgggccccgggcgccaccgtcacctcggccgctgcgctgtcgccatcgccttgtttcccsntcccccgsatggccgaggacctctctgcggccacgtcctacaccgaagatgatttctactgccccgtctgtcaggaggtgctcaaaacgcccgtgcggaccacgyctgtcagcacgttttctgtagaaaatgtttcctgactgcaatgagggaaagcggasacattgtcccctatgtcgtggaaatgtgactagaagagagagagcatgtcctgaacgggccttagaccttgaaaatataatgaggaagttttctggtagctgcagatgctgtgcaaaacagattaaatyctatcgcatgagacatcat

SEQ ID NO: 17863 - DNA, 127 bp, Homo sapiens
agagctacgcagccttcggtgcagtcgtcactcgtgtctcgctaccagctccccgctgccctgcgctcggcgggctggcatccggcccgggggaaagcggaccagcccttctgcaggtctgcggggc

SEQ ID NO: 17864 - DNA, 395 bp, Homo sapiens
  misc_feature 63..64: n=a, g, c or t
agagctacgcagccttcggtgcagtcgtcactcgtgtctcgctaccagctccccgctgccctnngctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggat

SEQ ID NO: 17865 - DNA, 401 bp, Homo sapiens
tcagcacatacaaaaaaattataaggtagaatgtgctataaaaaatgattaggtacagtggaagttagaaaggcttcactaaagatgtcgtatttgaattgggtctgagcatgaattagtcttcaggtgagggagggggttaaagaaaactctaatgaaggaactctagtatgtgtgaaggcaaggaggctggtgtgtttaggttgcagcaaaccaagtacaaccaggcttggacttgagtgactggaaagacaggaagatgccatgctgagaaaaactgcccatgccaagctgagaaatgttcagcagaaacataaggtgagctgcatatgtcatttaaaatgttctaggagccacatttttaaaaaatcaaaattaacaagtcaaaaaaaaaaaaaaaa

SEQ ID NO: 17866 - DNA, 361 bp, Homo sapiens
atccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtacacagtctcagcatggaaaatgccaaccaagaaaatgaagaaaaggagcaagttgctaataaaggggagcccttggccctccctttggatgctggtgaaatactgtgtgcctagaggaaatcgtaggcggttccgcgttaggcagcccatcctgcagtatagatgggatatgatgcataggcttggagaaccacaggcaaggatgagaraaga

SEQ ID NO: 17867 - DNA, 408 bp, Homo sapiens
agagctacgcagccttcggtgcagtcgtcactcgtgtctcgctaccagctccccgctgccctgygctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaaatgaagaaaaggagcaagttgctaataaaggggagcccttggccctccctttggatgctggtgaatactgtgtgcctagaggaaatcgtaggcggttccgcgttaggcagcccatcctgcagtataagatggggatatgatgcata

SEQ ID NO: 17868 - DNA, 223 bp, Homo sapiens
aaaaaaagcgtcgcaagccatgagtgcccacaaggaagcatggcactctggcgggcataccagcgggccctggccgctcacccgtggaaaktacaggtcctgacagctgcagctggtggagaggcggggtctgcaggaacaccagaraggccggaytctgaccatggtgtccctgggctgtggctttgtgggccctgtggtaggaggctggtacaaggttttg

SEQ ID NO: 17869 - DNA, 349 bp, Homo sapiens
taaactaccctagagaattagataatttttacgtaggcctattagaaaatgctacagtgtcggccgggcgcgttgtatcaagcctgtaatcccagcactttgggaggccaaggcaggaggattgcttgggtccagaagtttgagaccagcctgggcaacatggccagaccttgtctgtacaaaaaatacaaaaattagccgggcatggtggcacacatctgtcccagctactcaggaggctgaggtgggagaattgcattagctcaggaggtcgaggctgtagtgagccatgattgcaccattgcactctagcctgggtgacagagtgagaccctgttccaaaaaaaaa

SEQ ID NO: 17870 - DNA, 122 bp, Homo sapiens
gacgatttcaactgaagtaatgaaggcagtgtcgtgctgtcgagagaaaggtggatcccaacaacaggaaactacctaaatcaccgaccagttctggtgctgcccgcgaagggstgcctcgc

SEQ ID NO: 17871 - DNA, 283 bp, Homo sapiens
attagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattctttttttttttttttttttt

SEQ ID NO: 17872 - DNA, 275 bp, Homo sapiens
attagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattctttttttttttt

SEQ ID NO: 17873 - DNA, 470 bp, Homo sapiens
catcttaaactactggagcatagcagttatctcaagcagataattagtgctagtttttctctttgtccctaacatgatgaatataagttctactcaacagagtataaactgcacaagagcagaaaattttgtctttcctgttaaatgatacatctttaagccttaaaaagtatttcttggaaaaaaaaagaatgagtatcagacaaattcattgcttatatctgctcacatagagtattctctacattagaatccaggtactcttgatcctcttttagagaataaggattgagctgaggaccaagtacttagcattgagaagtgtggctgacattacattacacagatttttttttttgacagggcctatgagattttgttttctcattcataagaaaggttctattctagtatgcatgtggggaaataaattaagaacttgtgtggtgttactcattatagccactgaa

SEQ ID NO: 17874 - DNA, 379 bp, Homo sapiens
gttgttttcagtgatttttgatagctcccattaatgggttctttgcaccacccagcatcctaactcatgatgtgtactgttatgtataatcttggcattgatctcattagctataaaggttgtcctgattttttttcctcaacttccaccttgatttctctcaccagtgccacagccaggaataaagaacaagagcgttttaattagatcagatttacattctgactggctcttaaactagcaaggtgacctagggaaaggggccagggtttccctctatcattcataaatgtaattcagggcccctttttatccccaataccagcatacagaaactgctgtaaaagaagaagttgtgggtattttttttttttttttt

SEQ ID NO: 17875 - DNA, 357 bp, Homo sapiens
  misc_feature 323: n=a, g, c or t
atattttgctgactggcaaggttatatgaagtgcttttattgaagcaccattttaactaatagctcctggtattttctgcttcccttcgtagggaatttagttattttattttattatttagctaatttagctattttaaaatagctaaattttagctactttkttttcaattgacaaagaaggatgtctaatcaaagactaccgctgattttttctctgttgtttatctgcttcttcggggagagtttctgcatttgtgatggaactgtctggacaaaggttggatgggagattcttccagaagaagtacattattggaaankgktgtttatatctcatttataatttattacaag

SEQ ID NO: 17876 - DNA, 442 bp, Homo sapiens
catttcattgccgcccagaaaaaggagggattaaaagttcttttaagatatatttccaggggagacagagtaagatggctccaccaattgttcccctgacaaggacaccaatttaacaatcatctacacagaaaaaacaccctcgtaaggataaaaatcaatacatttgctcttggatcccatccaccacgctgtgaggaagccaaattacctcatgaagatgccctcaaggagctgaaccaaaggctctggcccatagccttacggatctccaagttgaaagtcagcaccaacctgctagtcataagagtgagtcatcttgacagtagatcctccagcctccaacagatgccctgtggagcagagaggagtcattcctatcaaaccctgaaaaattctagatctctaataaaataaattattgatactaaaaaaaaaaaaa

SEQ ID NO: 17877 - DNA, 201 bp, Homo sapiens
cagttaaacttcagttctgtgttcaggtcacttgaacaacattccaaactatggaaataattttttggctctgcggagatgtgtggtatttttagctttctttcccttatgtcaccagtgtgagatactgatatctgaggtatgtttcactcagtcagcctcactatttcttaaactacataggaaaaaaaaaaaaaaaaa

SEQ ID NO: 17878 - DNA, 512 bp, Homo sapiens
accaccttccacatcgtatacatcaccagatggagtcttgctctgtcgcccaggctggaaagcaatggcgctatcttggctcactgcaacctccgtctcctgggttcaattgattcctctgcctcagcctcccaaatagctggaattacaggacactcagaaaaaaaatgaaattatgagaattgttttctcaaatccttttctactgcaaccttcccaccattacgagcataatgaaactcaaatgtgagtccaaggaattattatcttcatttttctactgaggagaactatcaagacttctaatcacatggaataactcattcaggaaatgaggctgggttgctgatgatggaatgagggagttggagggattagaaatgacgtatccataatagacaatggaatcggtgacagacttccactagtggcagcaacctgtgcctcactcctgcacaaatccaaaagggtttttgaggcatttgatggcatgtgctgtgaamaagtagata

SEQ ID NO: 17879 - DNA, 420 bp, Homo sapiens
attgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgtttttgtttttcattttctttttttctcttgactcctccttttaggatgtccagatgtaaaaaaaaaaaaa

SEQ ID NO: 17880 - DNA, 114 bp, Homo sapiens
attgtaatgatagagaaaaaaacaaggaaaactatttaatgaaagcacgatatttatctttggtaaatgactttagagcagttaaagacattgcttaaaaaactcagatcagaa

SEQ ID NO: 17881 - DNA, 504 bp, Homo sapiens
actctgagatgaacactttgagcaaacagggccaggacatcacagtgacccaggctgtgaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtcttttttttttttttggcctttwaag

SEQ ID NO: 17882 - DNA, 636 bp, Homo sapiens
actctgagatgaacactttgagcaaacagggccaggacatcacagtgacccaggctgtgaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctggtaggtgacatttcttctattcgctaagcccattttgtgataacacagttttccatattgacaggattgttttcatcaccaaaggaaaaccgtgggtccatgttcctgtgacaatctctttgtctcattcccaacaccctctgttctgtgtttaaacctctacaaaccaggcaaactggggactatgtgtaggacccagacatggaggagaaagcaggcattgtttctacttaccttatctgcccctcccactaaggtaccagttagtacaaccacgtaacactcacaagtcctacacttc

SEQ ID NO: 17883 - DNA, 472 bp, Homo sapiens
gaaaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtcttttttttttttttggcctttaaagrcctttcaaaamcaaaaaaaaaaa

SEQ ID NO: 17884 - DNA, 386 bp, Homo sapiens
  misc_feature 340: n=a, g, c or t
cagaacaaaaacggagcttcaaaatcatggcgtgcctgcttcttctgggttcttttaactgcaagcaatcagctttgaagagcacgtagggaacttctgatgtgatacaaacttttgtcttttttttttttttgtcttttaagagcattcaaaaacacttggtctggctgtttcaattttctctttctctcctattcctagctcaagaataacatttacatatgaaagaaaataggagatggctcagaataatatgtccaaggccacgcccaggcgtcagggattcatgaattttgtatacagtgtatgatgtttctagattaaaatattttcaaaggtnaaaaaaaaaaaaaaaaaaaaaaaggaaaaaaaaaaaaaaatgcgaa

SEQ ID NO: 17885 - DNA, 432 bp, Homo sapiens
  misc_feature 424: n=a, g, c or t
aaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtmttttnktgggttt

SEQ ID NO: 17886 - DNA, 508 bp, Homo sapiens
aaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtcttttttttttttttkgcctttwaagrscwtycaaaamcaaaaaaaaaaaaaaaaaaaaaaaaaaaaaaaaaaaaaaaaaaaaaaaaaar

SEQ ID NO: 17887 - DNA, 433 bp, Homo sapiens
caatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggctacttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcaaaaaaaaaaaaaaaa

SEQ ID NO: 17888 - DNA, 494 bp, Homo sapiens
atcagtgaatgcttctcgtctgagagtcacttatcacgtagtcagtcttcttgagtctctaagatttaccctgttggagcagtctctccccatctcacagcgaccagtgcatgtacatttctcacttctttcatagtcttgtccccacgctcaagaattactttatgttcatcttgattgttctgttgtcttcctatacaagttatgctggctatccagattctgtgattaaaaataaagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatc

SEQ ID NO: 17889 - DNA, 478 bp, Homo sapiens
agtcacacctctatctctcatctttccgctcttagctgggagtgctccgcctagtcacttttcttaaggtggctcgtcgaagcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgcccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggc

SEQ ID NO: 17890 - DNA, 462 bp, Homo sapiens
atacataaggaactgaagactgcctccacttagtagcaagagaggaactgaaccactctgcccaacaatcctcaaggaaacggatcctgccaacaatcaagttacataagctccaaagcctagtctgtcccaggtttgtcaaagagacaagatggccgaataggaacagctccagtctacagctcccagtgtgagcgaggcagaagacgggtgatttctgcatttccaactcaggaagccaatgaagaaggaagcaaatatagaggaggaaaggggataaaaggaagaataatctcagaaaaggaagatagagatgctggagagaagacacctctgtatttgtaggctctccccacatcttgtgagtcactaaagaaaaaccagttgttccaattgttttaacaaaaccaggaactgagattctaaatttacatactctcataccattttatgtttatgaga

SEQ ID NO: 17891 - DNA, 183 bp, Homo sapiens
  misc_feature 161..162: n=a, g, c or t
gaaatgggctgagtccctcttgctcacccttgacttggaaaaaccagtttctcttttattgtctgttactaatctctattctaaaaattcagctcaattctaaaccatactccaaactctctcttttccagctacctttactccctctccttcaattccdnnttcctctgcttactttttttt

SEQ ID NO: 17892 - DNA, 426 bp, Homo sapiens
  misc_feature 417: n=a, g, c or t
aaataaccgcgcgcgcstcggcgttcccgcaaggtcgctttgcagagcgggagcsgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggaaaaaccatatggcatagttgaaaagaagtccagaatattccctggtgatacaattctggagactggagaagtaattccaccaatgaaagaatttcctgatcaacatcattaaagnttatgtaaa

SEQ ID NO: 17893 - DNA, 399 bp, Homo sapiens
accaattaattcgactgctctctgatccacttgaagaactcagctggaaatcaaacaaagccaacctaaaaaaaaacgtctaacactagagtattcctgtatcctggagaaggcagcactcgagccaccatcttggaagtgaagatcaggccctcagcagacacaaaacctgccagtgccatgatcttggatttttcaacctgcaggactaggaagaaacaccagggatggaaaccacagagaaaaaaaggccatggtcatgtgaggatgcagtaggaagatgatcatctgcaggtcaaggagagatgtgtcttgagaaccaaccctgctggcaacttgattttggatgtccagcctccagaactgtgaagaaaataaatttctgctctttaagtcaaa

SEQ ID NO: 17894 - DNA, 519 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgamactgtgcctagcctgagccaccacgccggcctaatttttaaattttttgtagagacagggtctcattatgttgcccagggtggtgtcaagctccaggtctcaagtgatccacctgcctc

SEQ ID NO: 17895 - DNA, 315 bp, Homo sapiens
  misc_feature 12: n=a, g, c or t
agakcgggasgngcttaagthactagtccgtagttcgagggtgcgccgtgtccttttgcgttggtaccagcggcgacatgacggggtacactccggatgagaaactgcggctgcagcagctgcgagactgagaaggcgatggctgaaggaccakgagctgagccctcgggakccggtgctgcccccacagaagatggggcctatggagaaattctggaataaatttttggagaataaatccccttggaggaaaatggtccatggggtatacaaaaagagtatctttgttttcactcatgtacttgtacctgtctg

SEQ ID NO: 17896 - DNA, 424 bp, Homo sapiens
aagctgcccgcaatacgtcatggcgaccaaacgccttttcggggctaccggacgtgggccggctggggggcctgggagctcctaaaccccgccacttccggaagactcctggcccgggattatgccaagaaaccaggtgagctgggttaagaggaaccaaatggggacggtgggtgcactgaggaattgacagtgcgcaggcggtggttggggaggtggtgctagaactgatgcgcaacgcagagaggcggatgcaggctgtatgcgcaggcgcagtttgagggacccagcgccttggagctcgggcgtctggctcggagatactgtagcgattggacccagggcgcaggcgccagcttggggcggasggcctkggaggaggatgtggttacgtggagaccacgcgtttcactgcgcaggcgcg

SEQ ID NO: 17897 - DNA, 448 bp, Homo sapiens
ctgacgtcttccggaaacgtgcacttgcaagctgcccgcaatacgttatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgtttgagatgaacttgggtcccccaaagaccctggaggagctggaccccgagagccgggagtactggcggcggctgcggaaacagacatctggcgccacaaccgggctgaagca

SEQ ID NO: 17898 - DNA, 484 bp, Homo sapiens
taaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatc

SEQ ID NO: 17899 - DNA, 501 bp, Homo sapiens
catttcactatcaggctaacctctcttaattctctgaattaataggattttattttaaataatgtttgtaggtattggtagattctttattaagtacatttccatttttgtttagaaattttaattatatatttttatatgttattaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcagtaataacataaagcagtacaaaagaaaaataaatctaagagggaccaagtacataatcattattaatacactggaatttcaattttaaaatatttcaggctgggcgtggtggctcacgcctgtaatcccagcactttgggaggccgaggtggatagatcacttg

SEQ ID NO: 17900 - DNA, 288 bp, Homo sapiens
cagatttcctgcttgcatggtatttgagacttgaattttgtggtttgtacagcaaaaggttaaatgtcatgaatggtaamccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgtttt

SEQ ID NO: 17901 - DNA, 402 bp, Homo sapiens
attgtgacctgggagccctgcatgatgaagggatgatgggtgagctaccaaggctaacattttcccgaggacattgagttagggaagtggcctctccttgagggaaggagccagatgacttctcagagaacaacaaccatattcaaaatattctcaagtttcttttgtttcttcttgtctgcatctgaatccaggacattattccacaggaaaaggttaacaggaaatcaagatcggcccgctcctacagcaaaagaagtactaagaggaaagtttatagtgataagcacctacataacaaaaaacttcaaataaacaacctaatgaggcatcttaaggaatgagaaaagagcaaactgaatacaaaattagtagaagaaaagaaataataaagttcacagc

SEQ ID NO: 17902 - DNA, 380 bp, Homo sapiens
aacattttcccgaggacattgagttagggaagtggcctctccttgagggaaggagccagatgacttctcagagaacaacaaccatattcaaaatattctcaagtttcttttgtttcttcttgtctgcatctgaatccaggacattattccacaggaaaaggttaacaggaaatcaagatcggcccgaagtctggctcttatcacctctgaatagcatgccattctcttagcctcatctaagaaacagactgtaggggaagagaagatctagaatgttggtcaccaaccaatggcagacattatcagacaatttgtgagcaaggaagtcaggaactgtgagccacctgccatcttaatttgacatctagtctcactacttt

SEQ ID NO: 17903 - DNA, 483 bp, Homo sapiens
aaatatatgttctttctacatcacccctctttctactaaaaataatctcagtaagattattattattattattatttttgagacagagttccactgcactctagcctgggtgacagagtgagaccctgtctcaaaaaaaaaaagamctagttcacacccatgtttcctcctgctgccccaaattgccactctcctggagcagcccctgaaggtggagaccaggcacctgctggagcaggaactcttccttcaccggcttctgttggggccccaggatcctgcagctgtggcatccacagggagtaaggccagccacggaggtcctttcatgtcaccaagctgcaggggaggaaaagtgacatcagacagatcaacaggagaaaacccattttaatgatatgtccacgaatgggagtccacacggagatgaaactgggggaaggggccaratggcggaggcgtctgcgtcatcctcagctgcag

SEQ ID NO: 17904 - DNA, 258 bp, Homo sapiens
  misc_feature 253: n=a, g, c or t
ttccctctcacggttagcgctacggctccaaggctggcgcctgctcttcttcatctccctccccggcccttggcaggagcctcgccctacattggctcttcaagtccgggcgtccccttcatgtgggagacacagcccagaccattccatcgccctggattctgcccggaccagcgacctcgccggactgaagatttctccagcaagattgttttaaataaagtttttgccatcaaaaaaaaaaaaaattccnaaaag

SEQ ID NO: 17905 - DNA, 453 bp, Homo sapiens
agaagcgaaagatgactgcgagttaagtcacgggagggcgtaaccgaagtgggagagagctgcggctccggaacgcccggcaggcccagagacgcagcagatggtgcctgaagagagagggcgttgctgcaasgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggctttt

SEQ ID NO: 17906 - DNA, 435 bp, Homo sapiens
  misc_feature 352: n=a, g, c or t
aagtcacgggagggcgtmsaccgaagtgggagagagctgcggctccggaacgcccggcaggcccagagacgcagcagatggtgcctgaagagagagggcgttgctgcaasgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggantcttcgttgctgcaattgcctcaggtggaataagccttcctaaggaggaccagataagaatctttggaaatggcttttttttt

SEQ ID NO: 17907 - DNA, 299 bp, Homo sapiens
accgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggctttttttttttt

SEQ ID NO: 17908 - DNA, 464 bp, Homo sapiens
  misc_feature 441: n=a, g, c or t
agatgactgcgaagttaagtcacgggagggcgtmrccgaagtggtagagagctgcggctccggaacgcccggcaggcccagagacgcagcagatggtgcctgaagagagagggcgttgctgcaasgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggnttttttttttttttttttttttt

SEQ ID NO: 17909 - DNA, 295 bp, Homo sapiens
  misc_feature 240..241,243..244: n=a, g, c or t
accgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggagtcttcgttgctgcaattgcctcaggtnnrnntaagccttcctaaggaggaccagataagaatctttggaaatggcttttttk

SEQ ID NO: 17910 - DNA, 447 bp, Homo sapiens
  misc_feature 24: n=a, g, c or t
aagtcacgggagggcgtmrccganagtgggagagagctgcggctccggaacgcccggcaggcccagagacgcagcagatggtgcctgaagagagagggcgttgctgcaacgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccatagaacttggttcagtttcaaaggctaatgtagtccctgggttttctgctcaatgtgaattacgctgcctgtgccttagaggaagccgcggastcttcgttgctgcaattgcctcaggtggaataagccttcctaaggaggaccagataagaatctttggaaatggcttttttttttttttttttttt

SEQ ID NO: 17911 - DNA, 93 bp, Homo sapiens
tttctctctcacagatagtgagggtctgacatgcccatgccacctatgccacagtgcctaagggctaggccacccagagactgtgcccggagc

SEQ ID NO: 17912 - DNA, 500 bp, Homo sapiens
ttccatcttacttttaccaactcagattcttcagccatttgcattgatagccactccccagcatctgctccctcaaaggtgaaaaccagaaattggcagtagatgatatgcaactattaaatataatgtgaagctttagtctcaataggtttggacaaataataaatgaaagtaattttcaaaactgaagggaagtaataccaagaaagtcagcagagtgaaaagaacactggatagaatgaagagacaagactcttagtctctggccaactttgggagacttaattcactttccaggcctcagtttcctcaatcaagaaattggattttaggcatcttttatcagtaattctaaatccgagttgcgaggacagagaacctggaggactgacactgggaagattacagaaggcagagctccagagggcaaagcaagaaaatgttacaaatctatttattcaatccttgaatctgagtatatctgttccactaccaaaaaa

SEQ ID NO: 17913 - DNA, 117 bp, Homo sapiens
ctagtaggccaagggcttcgcccggggcgaatgggacgcccgttccggggtaccagccgcttgcagccagaagttcctcggatcccttggaagcgcaaaaaaaaaaaaaaaaaaagc

SEQ ID NO: 17914 - DNA, 107 bp, Homo sapiens
ctagtaggccaaggrcttcgcacgggcgaatgggacgcscgttccggggtaccagccgcttgcagscagaagttcctcggatcmsttggaagcgcaaaaaaaaaaaa

SEQ ID NO: 17915 - DNA, 481 bp, Homo sapiens
agaaaggcagcttcaactcatgcactgagccctgaggttactgggaacggcaggtgcaaatatctcatgaggagatagaaagttggcataatttggatgagaaaggctactatggctgcaatatggtgagggaggaggttggagcttcagaagcaggtggaggacagatgtgcatgatttagagaaccaagggaaggarttgggtttttatctgaaatctgatgagaaattatgtttgcaattgatttctcatcagattttactaaaatacagagaatcagtaggaagggtactagctgtactctgatagatttctaagtactgcaaatggtgctaagtgctttgtagctgttctcttatttaatccttagaacaatcctgtgaagaaccttctaaatctgatggtatttatggctgtaagttgctggcaatgttttaatctctttgtataaataaagtcattttagccttacaaaaaaaa

SEQ ID NO: 17916 - DNA, 546 bp, Homo sapiens
atcactctttagaatccctgcaactttgagcaagttcgtgaatctcactaaggctcagtttcctccataaaattaatcaatatcagggcctctgcattggacaactccagagggcaccattggggttataccttgtgtttgcctaaccttcattgcagtgggcaggtgcatgctttctacaatgtcctaaggtctaaaggggtagagttctgtgtgtggcattttaggcctggaaaggatgagagtctacaaaaccagagaaatactgcagagctcctaaagtccttggaatgtcctaagtgcaaatggtcaaacccaggagggaatggtatgaacctctggtttacagccattggtaagaagcacacatgacaacctggactttccatcaacatttgaagcgggacagtcttgtgggatcaagctcttaacctgtggggtctgctactaactctgaatccaatgaacacatggacccaacactcctttggccaagttgatgattctccaccatttatttgcctgsctcactatacacttctagca

SEQ ID NO: 17917 - DNA, 512 bp, Homo sapiens
  misc_feature 288,442: n=a, g, c or t
atcactctttagaatccctgcaactttgagcaagttcgtgaatctcactaaggctcagtttcctccataaaattaatcaatatcagggcctctgcattggacaactccagagggcaccattggggttataccttgtgtttgcctaaccttcattgcagtgggcaggtgcatgctttctacaatgtcctaaggtctaaaggggtagagttctgtgtgtggcattttaggcctggaaaggatgagagtctacaaaaccagagaaatactgcagcaaatggtcaaacccangagggaatggtatgaacctctggtttacagccattggtaagaagcacacatgacaacctggactttccatcaacatttgaagcgggasagtcttgtgggatcaagctcttaacctgtggggtctgctactaactctgaatccaatgaacacatngacccaaacactcctttggccaagttgatgattctccaccatttatttgcctgcctcactatacacttct

SEQ ID NO: 17918 - DNA, 293 bp, Homo sapiens
rtyawtckdkkagarkccctgcrrctttgagcaagttcgtgaatctcactaaggctcagtttcctccataaaattaatcaatatcagggcctctgcattggacaactccagagggcaccattggggttataccttgtgtttgcctaaccttcattgcagtgggcaggtgcatgctttctacaatgtcctaaggtctaaaggggtagagttctgtgtgtggcattttaggcctggaaaggatgagagtctacaaaaccagagaaatactgcagagctcctaaagtccttggaat

SEQ ID NO: 17919 - DNA, 207 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaa

SEQ ID NO: 17920 - DNA, 215 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacata

SEQ ID NO: 17921 - DNA, 246 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaaaaaaaaaaaaaaaaaaaaaaa

SEQ ID NO: 17922 - DNA, 218 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaa

SEQ ID NO: 17923 - DNA, 266 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaaaraaaaaraaaaaaaaaraaaaaaaaaaaaaaaaaaaaaaa

SEQ ID NO: 17924 - DNA, 241 bp, Homo sapiens
aagaagccacagtdgctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaraaaaa

SEQ ID NO: 17925 - DNA, 262 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacytcmagctatgcactttttctaatcttaataaattttaataaacataaaaaaaaaaaaaaaaaaaaaaaaaaaaaaaaaaaaaaaaaaaaarr

SEQ ID NO: 17926 - DNA, 259 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaamaaaaaaaaaaaaaaaaaaaaaaaaaaaaaaaaaaaaaaaa

SEQ ID NO: 17927 - DNA, 270 bp, Homo sapiens
aagaagccacagtagctccagtgcatggagcagactcccctttcctactctatgctgtagtgctgagctgacatgaaacaaatctttagtagtagaatattacattttgggtctacttgtttagactaatttagcccatcttatctttaatgcaaagcatttttattaacttcagctatgcactttttctaatcttaataaattttaataaacataaaaaaaaaaaaaaaaaaaaaaaaaaaaaaaaaaaaaaaaaaaaaaaaaaaaaaa

SEQ ID NO: 17928 - DNA, 217 bp, Homo sapiens
aagaagccacagtwgctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaactttcagctatgcactttttctaatcttaataaattttaataaacataa

SEQ ID NO: 17929 - DNA, 235 bp, Homo sapiens
  misc_feature 219: n=a, g, c or t
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaanaraaaaaaaaaaagaa

SEQ ID NO: 17930 - DNA, 225 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaa

SEQ ID NO: 17931 - DNA, 248 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaaaaaar

SEQ ID NO: 17932 - DNA, 225 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaa

SEQ ID NO: 17933 - DNA, 226 bp, Homo sapiens
  misc_feature 14: n=a, g, c or t
aagaagccacagtngctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaa

SEQ ID NO: 17934 - DNA, 218 bp, Homo sapiens; identical to SEQ ID NO: 17922

SEQ ID NO: 17935 - DNA, 228 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaa

SEQ ID NO: 17936 - DNA, 241 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaa

SEQ ID NO: 17937 - DNA, 242 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaa

SEQ ID NO: 17938 - DNA, 247 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaaaaaa

SEQ ID NO: 17939 - DNA, 243 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaa

SEQ ID NO: 17940 - DNA, 243 bp, Homo sapiens
aagaagccacagtrgctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaaaaaaaaa

SEQ ID NO: 17941 - DNA, 237 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaraaaaaaaaaaaaaaaaaa

SEQ ID NO: 17942 - DNA, 236 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaaaaaaaaaaaaaaaaaaaa

SEQ ID NO: 17943 - DNA, 248 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaatkttaataaacataaaaagaagaaaaaaaaaaaaaaaaaaaaaaaaa

SEQ ID NO: 17944 - DNA, 214 bp, Homo sapiens
  misc_feature 14: n=a, g, c or t
aagaagccacagtngctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacat

SEQ ID NO: 17945 - DNA, 245 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaagaaaaaaaaaaaaaaaaaaaaaaaaaa

SEQ ID NO: 17946 - DNA, 216 bp, Homo sapiens
  misc_feature 136: n=a, g, c or t
aagaagccacagtagctccagtgcatggagcagactcccctttcctactctatgctgtagtgctgagctgacatgaaacaaatctttagtagtagaatattacattttgggtctacttgttagactartttagccnatcttatctttaatgcaaagcatttttattaacttcagctatgcactttttctaatcttaataaattttaataaacatar

SEQ ID NO: 17947 - DNA, 225 bp, Homo sapiens; identical to SEQ ID NO: 17932

SEQ ID NO: 17948 - DNA, 229 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcacttttttctaatcttaataaattttaataaacataaaaaaaaaaaaaa

SEQ ID NO: 17949 - DNA, 219 bp, Homo sapiens
aagaagccacagtagctccagtgcatggagcagactcccctttcctactctatgctgtagtgctgagctgacatgaaacaaatctttagtagtagaatattacattttgggtctacttgttagactaatttagcccatcttatctttaatgcaaagcatttttattaacttcagctatgcactttttctaatcttaataaattttaataaacataaaav

SEQ ID NO: 17950 - DNA, 520 bp, Homo sapiens
acagaggaaaggccatgtgaagcaagaaggcagccatctgcaagccaaggagagaaatttcagaaggaaccaaccctaccgacatcttgatcttggactttaagctgccagaccttttatacattttctacagaaaatgcaccccatcattgcttatagcccacccacgtggactgctcattctgtgaatcatgttttacagatttgtttatgtggcattcctcgtttgaataaagcagaaccaaatgtcttcgtttgaagagagagatgaaatgggagggccacaaatagtaatttatctttgagcatcgtatagataaacatgtaacctgatactaaacaaaagtaaatgctcatggactgtcagtgatgtggtgggatatgccagagggaagtgatttgtggactcactggagagagacttctactagaaggaaagatttttgtaagagaaaatgaakgagtagagaaaattaccaacaagaaccatgttgcacaatgttaaaacacagttctgcta

SEQ ID NO: 17951 - DNA, 444 bp, Homo sapiens
aaaccctaaatttgaaggtcactgaagctgtccctccaccccctgtcaatttactaagagagggttagaggaaaagtaaccccttcacaacaacgtccagagatgtgtgtgtggtccttggtcaggaaccaaaatggttctgttatctcatgtaatccttataacaacaagagaagataggtgctattaagatttcaaacccaggtctactccaagcccctggctcatgaggatctctaggtgacttctctgttctctgccctctgctcatgccaatatcattgaagcataatgggaagttacctactgcctcctaatgagtcgatttaccagtctgtaaaatgggcataatgttgccgcttctccctggggccttgtgaggattaaatgtggggaagcaggtgctcccagaaagtgtagtttagactgtgtcctctcctcctc

SEQ ID NO: 17952 - DNA, 489 bp, Homo sapiens
gttaaacaaattcttggagagggcgagagtggtgactaaagagaggagcctttcctccccttttgcctgcgctccggcggcggagagcctttggaaggaattgggccatgagaagagccctcatgaatgggattagttcccttataagaagagacaccaaggaagtgatctttctctgccctctgctatgtgaagacaaggtcatctgcagttttttgttgttgttgatgatcttcctgtcatagacaatgctgtaacaaacagactaattgttcactgttgacatatagaagtactactgattggccagacatagtggctcatgcctggaatcccagcactttgggaggccaaggcaggtggatcagttgaggccaggaggtggaggttacagtgagctgagatcatgccactgcactccagcctgggtgacagagtgggactctgtctaaaaaaaaaattgtattatctgtaaacggaaatataaat

SEQ ID NO: 17953 - DNA, 495 bp, Homo sapiens
atgctgtagcaagttattgttaaaattttcatctgaagtgaactgtaatagtacccagaggaaagagaaccattttgaagaaggttcaactagtcttacatattttatatggcaaaatattcttatatattctgtgttcccaggtgaatttagatgaatgcagagggcatttgggggtgcaaaagtaactgagcgatgagatgcttataaagcagatatcagttatcctctgttcttggaatgatatctcataaaggcaaagaaatgacactggataatgcaaggcggtaagaggagaggagacagtggttccgtttgctgctggggaaatctttcctgtggaatggagacagaagaagaagcagagggctttctctctgtgaggtcatacactctggagccagtggtacaagtctccatctgactggccaggaagaaggtagcatctgcccattcatatacagaagaccagtggtgggaacacaacgcatttgt

SEQ ID NO: 17954 - DNA, 437 bp, Homo sapiens
  misc_feature 315: n=a, g, c or t
agtattctgtgacatattttgtgggaatgaagtggtcagtgaaggagagaggagttatctggtgactgggaagatggaaattaaacattgagaactcaggtcttcatcatgggaagatctagattatcagagagccttgatcattgaagaaacaacaaataataagtgtggctgttatgcaaagagagaagcaggaaggaccaggctgtagatcatgggatttaataaaggaactatgacagtgtaaaatagagactccatcatatcttggtcatcagcccgttgggatgcagagcccacatacatgaaggcgangggccatagtataaagatacagaactaatcaagctccagatggtgctgcaaactaaacaacacaaggacaagctgttcttccaaggaccttagatcacccccaggwggagccctagtgctgt

SEQ ID NO: 17955 - DNA, 538 bp, Homo sapiens
atcctgatggggctgataaaatcacctcaagatggctctaggccaccccaggttcttaagacaatggtcagctctttcttaagcagtccaagaccctctgacctgagatgtgactggatgattacagacctcttgtccagtgtttagagcctagctgtctgcatattttataaagatatctgccttccagagactggaagtgaaagagatccaatgactgggtgagtcaccctttctccacctagaacacagtccttgatggaactcatgctttatcaattgttgttgagtagaagaaacaaatacatcctccaatcttcacttggtggacctggcatcaaaaaataatcatattaagtgcgtttattagtacacttttctggcttatctgcctttccaagtttctatttgagttcttgcctttgaagggtttgcaggctgtgaaaagtaacttaactttttaacaactttctttgcttggccttgaggcagcttcagaagataagacgccaaaaggractatgtgtgcctggagaga

SEQ ID NO: 17956 - DNA, 219 bp, Homo sapiens
ctattatttttctcaggaatctggttaggaattgcaggcaatgagattttttgcggggcagggatgggaatgtttgttcataaataattagacattttctatagatatttgacattctgcgaaacaacaagcaaactgaagaccaactcctatgagaaatattatgatgtttatgtaataaagacatgtaactgtctcaaaaaaaaaaaaaaaaaagct

SEQ ID NO: 17957 - DNA, 487 bp, Homo sapiens
aaaaccagagccccgtgggctggaacgcgccggaatctgaggtgtgagtagagcctgggggagagtggatccaggtgaagggggcagaggactgggagttttcgtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggtagggttttgtatccagagagggttcagctttctcccgtgggctgggggaagaggtcaaagtagaactcaggtaccaaatttgaaaggaaacactcagaaraaacttctgagcgcagagcggaaaacaccctctcagtccccaccaaagagaaaagctttgggttctaaatttccagtttccattaagggactctgggactggacatttctgaaaattaatgac

SEQ ID NO: 17958 - DNA, 400 bp, Homo sapiens
attattgcgggatacttgtgaaatatacataggattctttcttatggctgcatcccggatctggaaattttacttggggaccaggaggatttgaaaggctgcatgtactcagaagatttgcaagcaacactccaattcttgtcatagatctcgcagacttctcacttatcggcttwtttccttccttattttttaagaattattcttattttcccctctctttttctgctctctcctctctcagtctctccttttctatctgcctcttcatttttctcctagtctgttttttktttttcctgctctgcacctggattgtatcttcagcaaacaatcgggcactttgagaactaactggagaaagtcttgtagggaagatctgtatggaattatctgcttt

SEQ ID NO: 17959 - DNA, 440 bp, Homo sapiens
tgtagtgtttgcagtagcgtttctcaccttccctgatgaagggtcttttcagttgcaaaccaacttgccacctcagcggcagaagttgagtgttgttcgtgtcaccacagagtctcgttctgtcacccagcctggtgtgcagtggttcargccattctcctgcctcagcctcccaagtagctgggattacaggcgcccaccaccaagcccagctaatttttgtatgttcggtagagacggggtttcaccatgttggccaggctggtctcaaactcctgacctcaagcgacccacccgcctcggcctcccagagttttgcgattacaggcgtgacaccacgcccagcggaatttcttattctttttgatctatcaaaacaacctcattgttctcaatgactgaccttataataagtaaatgttatagaacataaaaaaaaa

SEQ ID NO: 17960 - DNA, 478 bp, Homo sapiens
agtttctggtatttagaagtcatttatccttccgagagaaataataaagtttcatctactgagaaatgttttaatgattctcctcaaattttaataagtatgagaatcagctgggcaactagttaaaatttacttgctgatttaagttccactctttttgtcgacaataatatggcgcccaaacacgtggggcctcagagaagactctggatccggaaggagtatcccaaaaccagagctaaggtaccagctggagcccactgaagcctcaccgagtttgggcttctcctcctgtggaactggaaaccaaaatcatggtattttgaaaaccagaggtatgaatctccctcgtttggcatcccactgggcctggacctgtttcactgctaatgttctgctgccaaaactatacaagctgcctggactattgcagaagagagacagagtcttgctctgttgcccagaatggaaatgcagt

SEQ ID NO: 17961 - DNA, 427 bp, Homo sapiens
ttaaaagtaagggttgtgctattgacactttaaatttgttggcaattcataaaagttaaaatgattctgttaaaagcctggagtgtgctaacgaagggatctggttacaagaattatttcttacattggctatatgcaattcgtgatatttcactgacattttgggtttttttttaactgtaggttttatttttaacttgttttttaaactttctccagctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacg

SEQ ID NO: 17962 - DNA, 385 bp, Homo sapiens
acttactagccatgtgaacttgggcaagtgacctaatcctctgcatttcatctctaaattggggagaatagaagcatctacttcatgtagtagccaggattagaaggaggaggaataactgggccctggatagaatgtgatgaatgtatattcttaatgagaagtggaaataatttgtggttgagagctgtgcctcagatcagtgacaggatacatggctaggctatattttccagcagattaagagctgcagcccaagactctgaaatatgaagaaaaaaggagaagatgacagcatatctttttaaagaaatattttccagccaaatggtgcagcagaggacttccaggaatttgttcttgttctgtatcaaaggtgaagagt

SEQ ID NO: 17963 - DNA, 364 bp, Homo sapiens
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaagatggaagtcttaataatctcctcataggggattaaacaagaacatgagcacaccttttctaaaaaaaaaaa

SEQ ID NO: 17964 - DNA, 360 bp, Homo sapiens
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaagatggaagtcttaataatctcctcataggggattaaacaagaacatgagcacaccttttctaaaaaaa

SEQ ID NO: 17965 - DNA, 378 bp, Homo sapiens
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaagatggaagtcttaataatctcctcataggggattaaacaagaacatgagcacaccttttctaaaaaaaaaaaaaaaaaaaaaaaaa

SEQ ID NO: 17966 - DNA, 516 bp, Homo sapiens
  misc_feature 503: n=a, g, c or t
acttactagccatgtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattgggaggaataactgggccctggatagaatgtgatgaatgtatattcttaatgagaagtggaaataatttgtggttgagagctgtgcctcagatcagagtgacaggatacatggctaggctatattttccagcagattaagagctgcagcccaagactctgaaatatgaagaaaaaaggagaagatgacagcatatctttttaaagaaatattttccagccaaatggtgcagcagaggacttccaggaatttgttcttgttctgtatcaaangtgaagagttcgt

SEQ ID NO: 17967 - DNA, 468 bp, Homo sapiens
tgaatgattccttaactcgttttaaaaatgaacgaagcatattcgtgtgtgtgtgtgtatatactaagctcttgttaattattgtatacattttagcttataattaaaccattgaatcatggttatatggtgaaaagtaatattaagccattatgtggaatatttgtgagtaaactagtttttaccgtgaaattgtagaaagtactaaatcagaacttttgcttttttccatttgtgagcttgagccactcatttcatctcttttgtcctcttgttcttgatctataaaatcagaagattggatcaggttatctcttagagttccttgaaactccaaatgttcttatttttttacgtaggaattactggattgaataatggggttagaactgtgtgtatatatgtatatatctttgaaaactgggggtaaatcttttttcttttttgtttttggttttggtaaattta

SEQ ID NO: 17968 - DNA, 519 bp, Homo sapiens
tgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagat

SEQ ID NO: 17969 - DNA, 412 bp, Homo sapiens
acagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtccagctgctgcttggggatgtgcactgctggccgccggcttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctaaaaaaaaaaaaaaaaaa

SEQ ID NO: 17970 - DNA, 232 bp, Homo sapiens
attgcttctgatttttggactctgttttccatcttgcagttggaatgctccttccgagccaaagctataggaaggagaaggagatgctgactgacaaacaaggaaacataaggatgatggaaacttcatggctcaaaaccagatggtttgtctcttgaataaaccttatcttccctatgtaataaataaaatcattttcaggtctcctcccaaaaaaaaaaaaaaatgcgaa

SEQ ID NO: 17971 - DNA, 68 bp, Homo sapiens
atcgatctcgggtctaaggtccggccgggtcatcattcctgccatttccacagcattcgaggtaccac

SEQ ID NO: 17972 - DNA, 336 bp, Homo sapiens
atttttggtgcgagagaaacaataggacggaaacgccgaggaacccggctgaggcggcagagcatcctggccagaacaagccaaggagccaagacgagagggacacackgacaaacaacagacagaagacgtactggccgctggactccgctgcctcccccatctctactaaaaatgcaaaattagcccggcgtggtggcacatgcctgtaatcccagctacttgggaggctgaggcaggagaatcgcttgaacacaggaggtggaggtttcagtgagccgagatcgtgccatggtactccagccggggcaacaggagtgatactccatcccaaaa

SEQ ID NO: 17973 - DNA, 503 bp, Homo sapiens
cattttggtgcgagagaaacaataggacggaaacgccgaggaacccggctgaggcggcagcagagcatcctggccagaacaagccaaggagccaagacgagagggacacackgacaaacaacagacagaagacgtactggccgctggactccgctgcctcccccatctccccgccatctgcgcccggaggatgagcccagccttcagggccatggatgtggagccccgcgccaaaggstccttctggagccctttgtccaccaggtcggggggcactcatgcgtgctccgcttcaatgagacaaccctgtgcaagcccctggtcccaagggaacatcagttctacgagaccctccctkctgagatgcgcaaattcactccccagtacaaaggtgtggtatctgtgcgctttgaagaagatgaagacaggaacttgtgtctaatagcatatccattgaaaggggacatggaattgtggacattgtagataattcagactgtgaa

SEQ ID NO: 17974 - DNA, 472 bp, Homo sapiens
  misc_feature 418: n=a, g, c or t
cattttggtgcgagagaaacaataggacggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggstccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtgtgngtctttgttggggagtgggggagtcttttgtaatcaagacaaagccaaaggccc

SEQ ID NO: 17975 - DNA, 478 bp, Homo sapiens
aattttggtgcgagagaaacaataggacggaaacgccgaggaacccggctgaggcggcaggtaaagctcgcgtcctatggccctagtgcccgaggagctttgagggagattttttcaggctactgggaaacgggatctctgatcattggagtctcccaggttatttgggaaagacttcttccgtggtcattgtgggggaaatctcccggggtccctgtggattcgatttccctgggtcatttgggaggagggtttttcttctgatcattgggggagggatttccgtggttttgggggtccagcatcctccccggtcattggagggggtctcccgggtttgggggagggcaggatctttcctggtcattgagatctccccgggtcttgggaagcgcaagatctacggtgtcattgaggggtctccccaggtcattggcggccacgatctccccagatatttggcgggtggaggggtctt

SEQ ID NO: 17976 - DNA, 480 bp, Homo sapiens
aattttggtgcgagagaaacaataggacggaaacgccgaggaacccggctgaggcggcacttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctcagatgtcactggtatctaggcaacagggatgagcctgaacctccctgaggccagcttacttagcagagcatcctggccagaacaagccaaggagccaagacgagagggacacacggacaaacaacagacagaagacgtactggccgctggactccgctgcctcccccatctccccgccatctgcgcccggagatgagcccagccttcagggccatggatgtggagccccgcgcaaaaggcgtccttctggagccctttgtcaccaggtcgg

SEQ ID NO: 17977 - DNA, 435 bp, Homo sapiens
cattttggtgcgagagaaacaataggacggaaacgccgaggaacccggctgaggcggcagcagagcatcctggccagaacaagccaaggagccaagacgagagggacacactgacaaacaacagacagaagacgtactggccgctggactccgctgcctcccccatctccccgccatctgcgcccggaggatgagcccagccttcagggccatggatgtggagccccgscgccaaaggstgccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccaaactgggcgagga

SEQ ID NO: 17978 - DNA, 427 bp, Homo sapiens
gatttcgactccagcagaagttctgcaagatgacctgggaataaagttggccaagaagcctccgaggggagatcggcgtgtgaggtggagagccccacgtctacatgaggtgtgagatcccaacaggttgacaatggaagcagagctgagaatccggtcatcttatattaagccagatgctaaaaaggtttgaaaaaatcaatggactcaggctggtctccaactcctgaccttaggtgatccgcgtcggcctcccaaagttcttggattacaggcgtgacaccgcacccagccaggcagactgatttcaattcttttggttatacacccagtagagagatggcgggatcacatggtagtcctctttttaatttttttgagaaaacttcatactgttttctataatggctgtactaatttacatttc

SEQ ID NO: 17979 - DNA, 508 bp, Homo sapiens
ctaatccttaccctgttactgagttacagtttgattgtgaccacaaaagtaatcacagtcaacaggaatggctggcacaagaacagctggcatcaggtgcaactttctctctcctccatcctagttaagtgccattacttatgcccttacccttggattgtaccagcactgtctagccaagatagttttcctgtggctgatgaatcacatggtaagagggatgagggtggaagttgagggaagataagcagaacagtgaagatcctagccctggggagaataactgtctggcaaattaaagataacgagaatgactttcttccctgcctaggaaattgcctccaaaggtaggtacagaagtgttctaagttgggatagtatcactgggakaagaacaaggcttctagtgaagtgctgtgaaggcctaagtctttttaaatgatcctctgtttcacttgttgttgaaagggaaagttaaaattataaatgcctaaatatatgcacaaag

SEQ ID NO: 17980 - DNA, 510 bp, Homo sapiens
ctatcatgtgaccacttgtcacacttccatcaaacagtacctgccccttaggtgtgctagggaataaatgaaatgcctgrgacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggccaaaggggatacgacccttcagcaaactgacatgctgaaastgccctatggagaggctcatgtggcaaggaacagagggtggcttctggccaacacccagtgaggaactcaggccctcagtcaaacagcctgcaaggaactgaaccctgccaataaccctgggttgaaagcttccctttggagaagaactkagggctgtctctggtcaatagcactkaggaactkaatccagcaaacaattatgtgaagaaacttkgaagcttgtcctcccctctagttgagctt

SEQ ID NO: 17981 - DNA, 464 bp, Homo sapiens
ctatcatgtgaccacttgtcacacttccatcaaacagtacctgccccttaggtgtgctagggaataaatgaaatgcctgrgacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggccaaaggggatacgacccttcagcaaactgacatgctgaaastgccctatggagaggctcatgtggcaaggaacagagggtggcttctggccaacacccagtgaggaactcaggccctcagtcaaacagcctgcaaggaactgaaccctgccaataaccaggcagtgtcagcccccggccaatgaccaccatggacctccctgtagttgaacaaagttgggtttgctgactggtggcagt

SEQ ID NO: 17982 - DNA, 442 bp, Homo sapiens
aacacaagccttgccaccatcttggaagcagcccaccaccatcttggaagtggcccaccaccatcttgggagctctgggagcaaggaccccccagtaaaagtaatgcttattaagtgtggctatcttgagattttaggactgacatgtcattacagctgtcttacttcagattggcacactccactaacacttgaagtaagcaatatgaaatgtttaagtaatttcgtattgatgtgaagatctttgaggacaaatgagatgccctgaatgacaacacatccatagcccactccccgtgtcctaggcaagcccagctgttaagatcccctaaaagtctgctccagtgattgacgcttagtgtggattatggacactgtctcccacttgcagataggtatgataaaatataaatttcaaaattcaagaaaaaaaaaaaaaaat

SEQ ID NO: 17983 - DNA, 178 bp, Homo sapiens
ggatgtaagttactagcaagtaaggtctatgtatagttttacgtatgtttgtcacctgcaaaacaaccaccatggagcttttggaaaatatcagtaaaatgttattagacaagtaccactgcttgctgccattcctggttgcttgatggcagtagggtgtcttggctaagtgctccgc

SEQ ID NO: 17984 - DNA, 532 bp, Homo sapiens
actggacccagcccttagcaacggcctggcgacggtttccctgctgctgcagcccccgtcggctcctcttttccagtcctccactgccggggctgggccggccgcgggaaggacygaagggrwtacagcgtgtccctgcggcggctgcaagaggactaagcatgratggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcrtgagtaccagcataaagtgtctagaagtacttgtatgaatctgggtgctccagtgttgggtgcaaatatacctaggatagatgcagaccaacaacgaagagagaaactcaaaaaggaattagcacaatgtgaaaaagagttcaaattaact

SEQ ID NO: 17985 - DNA, 456 bp, Homo sapiens
catcctgatttaggctgtaasagattgcatcatggcgcggataccargagaggaacatcwgaggctgcgcaatctctaaggaaaagaggtttatttggctcactgctctgtgggctgtacaagaagcatggcaccagcatctgctcctggtgagaggctcaggctgcttccactcatggcagaagcttgctctggctaacaaccactatcatcaaagttgtctgaggaagacctcctgttgctgtgactgacgggactcttggtggaagccctattcccatgtgcccatggctgcagctccccaaggaagcaggacattgttggattctctaagaagctcagaggaagttacttctcactgtggtgccatatgggatttgaagtcgttctactcatgctctgtttttcaataaagctgcttctgcctctgtaaaaaaaaaaaaaawtgcgaaaagc

SEQ ID NO: 17986 - DNA, 63 bp, Homo sapiens
attttctcgagccgcctgtttcgggtgccgccatgttggtgaggagaaatcaccgtaaccacc

SEQ ID NO: 17987 - DNA, 138 bp, Homo sapiens
aaggtgttgcggccggcgccattttctcgagccgcctgtttcgggtgccgccatgttgagaagatggcgaattagaagatggtgaaatagacgatgcaggatttgaagaaatacaagahaaaaaaaaaaaawtgcgaa

SEQ ID NO: 17988 - DNA, 304 bp, Homo sapiens
cattgctgtcttataactttaaacatatttctttcctatttgtaataacaccaactttttgaatagtctgctaaaaagctttaagcagaaaatgttcttattagagagcaaacgtataaaattgcaaaggaatgcatcatgatgattagggcattcagattcaagaagagttttatgacagcttattctttgggagtgtaagagagcccttaatccattcaagagatgaagaaatttctaagaaagatataattcttagttgcttataagagcatgagatgaagcttttttttttttttttttt

SEQ ID NO: 17989 - DNA, 381 bp, Homo sapiens
ctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaacaaaaaaaaaaaaaaaaagg

SEQ ID NO: 17990 - DNA, 212 bp, Homo sapiens
gtctgtcggagtctgtcctcggagcaggcggagtgaagggacttgagcgagccagttgccggattattctatttcccctccctctctcccgccccgtatctcttttcacccttctcccaccctcgctcgcgtacgcatggcggasgtctgcggccactcagtcccattccatctcctcgtcgtccttcggagccgagccgtccgcgcccggc

SEQ ID NO: 17991 - DNA, 387 bp, Homo sapiens
  misc_feature 276: n=a, g, c or t
gaaaacaagcgcgtggaaagcttggtcggggcttctcacagccgcgcgcacagactggttctccccccgcgtctcccgggagcgtcgccgccacctgcacgcgtccggcacacaaacgtcggtctcaccccttagtttctggaagagaaaaaggaaaagccaccgagaggcctgaccctgaggggtcggggggagatgcgggcgcgtagtagagggaagcgactgaggagcgkggactgggcagcatttgaatggatgcgggtgccgctggcmvgnaaagacgcctgggagccggcgctggggagccgtkcatgggctgggatgtgtttggattccaatctgggcctgacaccagttcagtgacctcgggaagttccccaaccctgc

SEQ ID NO: 17992 - DNA, 419 bp, Homo sapiens
tattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaa

SEQ ID NO: 17993 - DNA, 439 bp, Homo sapiens
  misc_feature 431..432: n=a, g, c or t
atcctgatttaggctgtaasagattgcatcatggcgcggataccargagaggaacatctgaggctgcgcaatctctaaggaaaagaggtttatttggctcactgctctgtgggctgtacaagaagcatggcaccagcatctgctcctggtgagaggctcaggctgcttccactcatggcagaagcttgctctggctaacaaccactatcatcaaagttgtctgaggaagacctcctgttgctgtgactgacgggactcttggtggaagccctattcccatgtgcccatggctgcagctccccaaggaagcaggacattgttggattctctaagaagctcagaggaagttacttctcactgtggtgccatatgggatttgaagtcgttctactcatgctctgtttttcaataaagctgcttctgcctctccnnytttaaa

SEQ ID NO: 17994 - DNA, 469 bp, Homo sapiens
atcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccacggtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgttttgtacgagca

SEQ ID NO: 17995 - DNA, 461 bp, Homo sapiens
atgttgcatctatgagtcagttcttcactgctgttattggtatgtctatttactgaacaccctgcatggctttgtaagtaaactgaataggaccctgcattctctacttaaatagagccatctttcagaagagtgataacaaatgacttaatttggaagattcactcaagatccaatttgattcatcgcggacatgcctgcacctaagttcctggggccaaagtgaggaggcagcagttctccacccaatcagaccatcatcctctttttgtaactagtatctttaacactccccttactatcctgaaagctgagcgagtactgggaaaaaggaaatacccagacatttgagggatcactgacactgcttctgaattaatgctaattcctgaggattgcaaacaccactggatccaccaatcaaaatggggatctatgagtgaagttattatggtwagaca

SEQ ID NO: 17996 - DNA, 352 bp, Homo sapiens
gacttgaattttcataagtagactcttagaggttccttctgatgcttcagcacatttccttttctccaaagaaatgcttcagggccgagtgcagtggctgacgcctgtaatcccagcactttgggaggcccgggcgggcgatcacgaggtcaggagatcgagaccatcctggccggcatgatgaagcccagtctctaccaaaagtggaaaagttagacgggtgtggcggcgcgtgcctgtggtcccggctgcttgggtggctgaggcaggggaattgcttgagcccgggaggcagaggctgcagtgagccgagatcatgccactaacgacggagcaagactccgtctcaaaa

SEQ ID NO: 17997 - DNA, 287 bp, Homo sapiens
attgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgccaaggtgggcgggtcatgaggtcaggagattgagaccatcctggctaacacggtgaaacccgtctctactaaaaatacaaaaaaaaaaaaaaaaaaat

SEQ ID NO: 17998 - DNA, 147 bp, Homo sapiens
  misc_feature 52: n=a, g, c or t
gagtcatatggttcatcctgatttaggctgtaasagattgcatcatggcgsngataccaggagaggaacatctgaggctgcgcaatctctaaggaaaagaggtttattttgggctccactgctctgtgggctgtacaagaagcatgg

SEQ ID NO: 17999 - DNA, 317 bp, Homo sapiens
agaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaatt

SEQ ID NO: 18000 - DNA, 446 bp, Homo sapiens
agtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccgktccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacag

SEQ ID NO: 18001 - DNA, 417 bp, Homo sapiens
  misc_feature 376: n=a, g, c or t
gatttggatatccctagaacgttgagggcacgagtcggtcctgagaccaggtgctgtgggtcggtsstggggmtgttcaggcactcagggcagcggaagagagagagactaccgtcmtggagataacggttccacggaggcccaaggmgaaacggaaggatmctcatgtacaaaamtgagcggaatggagctagtgagcacgcatcaggtcctcagccagcagagccacgttccttatgagcaccgtgggtttatttcattttcctacaccactgacccgaatatgcccggcgccatggggactccggstttgggagaagctgacgttgttatccccaggaatagctgtcactcsggtscagatggcaggcaaganggactaccctgcactgctttccttggatgagaatgaactcg

SEQ ID NO: 18002 - DNA, 514 bp, Homo sapiens
gactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcggga

SEQ ID NO: 18003 - DNA, 293 bp, Homo sapiens
gtgagtggagcggggcggtccccagcacactagaggaagtcgtgctacccccgcggagttgtcgtgtgttctggattcattccggcaccaccatgtygaaggtttyctttaagatcacgctgacgtyggacccacggstgccgtacaaagtactcagtgwtcctgaaagkacacctttyacagcgmstcttaaagtttgcagcasawgaatttaaagttcctgctgcaacamgtgcaattattrccaatgatggaataggaataaatcctgcacagactgctggaaatgtttt

SEQ ID NO: 18004 - DNA, 510 bp, Homo sapiens
acactagaggaagtcgtgctacccccgcggagttgtcgtgtgttctggattcattccggcaccaccacgtcgaaggtttcctttaagatcacgctgacgtcggacccacggctgccgtacaaagtactcagtgttcctgaaagtacacctttcacagcagtcttaaagtttgcagcagaagaagtaagtacagaagttggaacaacctttatggaatgcggtttgccaatatgcttcaaatgtctttaagagttgcatgcactttgacccatcatttccatgtggcttcattactaggtttatgttatcaaaaagtaggatgatagttaagacttactttcagatataagaagcatgagttaaacaaattgacatatctgattaatgcaaccattgaaaattataagaatttaatgaatttttatgagaatttttatgaaaactaaaaaggtgctgatttttaaatgttttttaaaatgcaacattatatcacattatattctatatact

SEQ ID NO: 18005 - DNA, 302 bp, Homo sapiens
aagtgggagccacataccccgagctggaggcttgagctgtggtatctaggctcscctcactggggttggtggaggtgatggaggttgcagcttggccagcatggtagaaaggtggcagggcacgtctggcttttaccacccagttgcttcgagccaggagatggaggagtcatctgttgcacgctggaggctggagcctgcagatggcatggttctgtggctcasctcgctgcagttggtggcagagacagagactgcagcttgaccagagtggtggagtgatacgtatctcaagagcactc

SEQ ID NO: 18006 - DNA, 322 bp, Homo sapiens
agttagtcccggcaaagggctccgcgaagacagtgccgtcgttgggcgcgcgcgcgggcgggagctgtcggggcggggcggcaccgccgagctccgagctgcaggactttgaaatgaccctgtcctcagcctggaggatgcggtattctgattgtctggtgctgtgtcaactgggcctgcctctgggatagtgttgtggctgcctcacgagaaccctatatgccagttccagaagcaaaaacaaaaaaagttcgggtacagcggctcacacctgtaatcccagctcttagggagatggaaactggaggatcacttgaggcca

SEQ ID NO: 18007 - DNA, 431 bp, Homo sapiens
agccgccgccgccgtcgcagccgcagtcgccgcagctaggccctcggcgtcgcagggagctccgcagcgacgtggaccaaggtgtatgtggaatttgatgatcttgaatgggataaacgagagtgtgttaaagtttatgaagatttttcaactttcttggtggaataccacttaatctgggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcgggacgattgcttgaagccaggagttggagatcagcctgggcaaaaaagcgagacccc

SEQ ID NO: 18008 - DNA, 484 bp, Homo sapiens
acagtggctggcaccaygtaggaggacaaatcatgcttgtggagtgagtgaataatcagaaagcgtaggtcctgawaatagaagttaatgactgaagtatctacactwatttattccctaacatcccttgggcacttaactcttagttagatactgtttaaaacacttaaaaagtattacctcacaattactctatcctaaggtagcaactctatgatcccaggtttatcattgtgccacaggcttaggagggaggtctgaacaaaaatgcaagaaaaaggaacttctgtcctccaagccacgtcgtgtaaagatgcagcatacctctcagaaatttaagttaatagaaacaagcactacatgctaatgtacatggaatgtgtgactaacagagaaaaagtgatactgtgaggatgtaaaaagtgagctaactcgaaaagtcctcaagaagtagtgttaatggagtgcttcaagttggaaacaa

SEQ ID NO: 18009 - DNA, 472 bp, Homo sapiens
acagtggctggcaccacgtaggaggacaaatcatgcttgtggagtgagtgaataatcagaaagcgtaggtcctgataatagaagttaatgactgaagtatctacacttatttattccctaacatcccttgggcacttaactcttagttagatactgtttaaaacacttaaaaagtattacctcacaattactctatcctaaggtagcaactctatgatcccaggtttatcattgtgccacaggcttaggagggaggtctgaacaaaaatgcaagaaaaaggaacttctgtcctccaagccacgtcgtgtaaagatgcagcatacctctcagaaatttaagttaatagaaacaagcactacatgctaatgtacatggaatgtgtgactaacagagaaaaagtgatactgtgaggatgtaaaaagtgagctaactcgaaaagtcctcaagaagtagtgttaatgtaatacaaag

SEQ ID NO: 18010 - DNA, 198 bp, Homo sapiens
ctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccastgcgtacacggcgagtacaccgca

SEQ ID NO: 18011 - DNA, 497 bp, Homo sapiens
acatctttaataaactaaggaaataaaattctgtctttcgtcagcctgccttgactgtcaagaaatggcatgtgtccactgtaaagcaggtatatctgaacattgagaaggtttctgtgttataatgtaaagcaaactgggaccacacacatcaaggaaagtgaggtggagtggctgtgtctctaacttgccatgagacctcgagcgaaccacttcacttctctgggtttctggtgcatggtgtaactgtcacttaaaatgaggtgtcttcctctccgcaacatctgacttgccttagatgcttcagttcccacttctgtgagcagctagcatctttctcttctgctcctggcccactggagctccagctctacgctgcaactctctcaacatttccccttaaatgtccccttgtcatctccaaccactgtgtctaaaaccagcataaattccgtatttccaaaaacctaaccattagtcacccaggtttgaaaatt

SEQ ID NO: 18012 - DNA, 189 bp, Homo sapiens
attttcatctgcattttgcagttaggaaactgaggtccacatgtacacagctggtacctacagagccaagatccaaactcagctctgtcagagtggaaaaccagcatccctctccagcatgatgcctacacgagtaactagaggagactgtggaagcctgaggaattatctgccacttttttttttttt

SEQ ID NO: 18013 - DNA, 375 bp, Homo sapiens
tcaagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctctcaaaaaaaaaaaaaaaa

SEQ ID NO: 18014 - DNA, 500 bp, Homo sapiens
agaagtccttcttgtcctggtcgttgttcccgtctgagtaccagctccccactgccctgagggcgggacggcctgcggcggagggaaaaaggaagaggagaaggaaattgtcccgaatccctgcagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgcaggaa

SEQ ID NO: 18015 - DNA, 484 bp, Homo sapiens
aatcggttggggtgtttttcaagtgtgtgggtggtttagttttttcgctgtttggggccatattgcttttatgagctgtgacactcaccgcgaaggtctgcgaasttcattcatgtaagcccccgagaccacgaacctgccgagaggaaggaacaattgtagacgcgccgccttaagagctctaaactcaccgcgaaggtccgcaacttcactcctgagccagcgagaccaggaacccaccagaaggaaaaaactctggaacacatcggaatatcagaaagaacaaactccagacacgccgcctttaacaactgtaacactcacagcgagtgtctgcacttcgttcttgaagttagtaaggtcaagaacccaccacttccggacacaaaagtaaggggattacaggtgggagcccccgcgcctagcccaaactggcgctsgattcttcatttgtatatcgcagttagtaaaaggggctcctgac

SEQ ID NO: 18016 - DNA, 442 bp, Homo sapiens
agtcaccacagccgcggcggcaactgccgagtcggttccgcggccacggtaatgagggggatgtctggagacaccccgtccactgttgccctcgccctttactctaaaggggaatgaggagccctgagcagcgaacacagtaattgggattcccgcaactgcaaatcccgccccttccccgagcgctggccgacagtagggcggaccgacgctgagcaagggattacatcccaagatttacaggtgtgcagaacgtgggacaskkggggggcaggcacagacggccggcagagctgggagggatggattctatgttttaagggcccactttggctgcagtggagccagattatcgtctcgcagtaattcagactttacattgtttttttcattttcccatcacccagaaatacattaaattcttaatgtaaaaatgttaaaa

SEQ ID NO: 18017 - DNA, 71 bp, Homo sapiens
catatctttgcatttgtttctcgaatgtgatcaagttacttggaaactgtgtggtccttttttttcaggca

SEQ ID NO: 18018 - DNA, 167 bp, Homo sapiens
gatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagc

SEQ ID NO: 18019 - DNA, 174 bp, Homo sapiens
  misc_feature 111,163: n=a, g, c or t
gatttaaaggggcagtaccggcaagagcggcagccacaccggcagattgcagaccgggcaaggtcccccaggccaggatgtcaggcctggtgttggggcagcgggatgagnctgcaggccaccggctcagccaagaggagatcctggggagcacacggctggncagccaagggc

SEQ ID NO: 18020 - DNA, 278 bp, Homo sapiens
attcattcttcccacctctttgctgggctgactgctgctcgttcttgtgtctcagcttccamactccctcttcagggsctccctgtctaccctcactccagagtggccgttgccgcggcccacagttccccacctaccagtcttcccacacaggttgagagaggaggggatccaattgcctgtgaggaggacacggctcctgggtggamcctgcagattgtgaagttcaagtcacagctcctgggaargtctctgtgtgtaaagatcatgggggtgar

SEQ ID NO: 18021 - DNA, 502 bp, Homo sapiens
agcgccgcaccccgccggccagagccaccgtctctccagacgcggccccagcgcccactggggatggcaaagacgacatccggtgcgccgaggctgctcacaaaatcttcccacacaggttgagagaggaggggatccaattgcctgtgaggaggacacggctcctgggtggaccctgcagattgtgaagttcaagtcacagctcctgggaaggtctctgtgtgtaaagatcatgggggtgagacagattcagggaccacactctgctctgctctgtacctctgagtgtcgatccagctgccttgtgaccaggacacttagaagaagcatggaccctgcaagaggatgggctcaaggacagcttgcctgactgcagccataagggtgaagcctcttcaggtagagaaggactccaggtggggcctgtgcagagggttcttacgggcgcadtaggattggggctataaaatcagtaaatggaaaaggagccaggtgaaaaaaa

SEQ ID NO: 18022 - DNA, 59 bp, Homo sapiens
agcgccgcaccccgccggccagakccaccgkctctssagacgcggccccakcgcccack

SEQ ID NO: 18023 - DNA, 267 bp, Homo sapiens
agttttcaggcggattgcctcagatcacactatctccacttgcccagscctgkggaagattagcggccatgtattccaatgtgataggaactgtaacctctggaaaaagcgtggggaattgagcacataatactccaaataaccatcagatgattctaattccaacatgaccacgtccaggcaactgaactgtcccctggcaagaagtctaggactgaacctgtcccgggcccctgtacttggttcaaaggatttagcctttctctt

SEQ ID NO: 18024 - DNA, 505 bp, Homo sapiens
agtgcaatctgggcgatcgcttcctggtcctcgcctcctccgctgtctccctggagttcttgcaagtcggccaggatgtctcaggtacagcgcgtgcacagccaggctgcgaaggtgcagcgggcgggaggccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggaccgaggagactcagtccccatcccgaagcacagggcaggacgtcgcggcggagtggggaagcgaggagtccgtggccggggagcttggaggtcaggggaagtacgggg

SEQ ID NO: 18025 - DNA, 341 bp, Homo sapiens
tattataatattgttttaatggaagttcagcaattacaaagtagtatgtatgttcttgcaataaaatggccatcaagagaggaaaactaacgctgggtgtggtggctcatgcctataatcccagcactttgggaggccaatccaggcggatcatttgaggccaggagttcaagacaagcctggccaacatggcagaatggtggtgcgggcctgtcatcccagctactcaggaggctaaggtgggaacttgaactcaggaggcagaggttgcagtgagccaagatcatgccactgcactccagcctgggcaatggagcaagactctgtcccaaaaaaaaaaa

SEQ ID NO: 18026 - DNA, 451 bp, Homo sapiens
  misc_feature 425,437: n=a, g, c or t
atcatcttgtagctgctcccagtggcaaagagcaaccaaasractacatatttatcagtgatgaaattggacacactcgattttcctcccactggtaatatttgcagtcagcatgaatagactttctcagtacagttttcaactcctggcacaacagtatcctttttccaaactatagcataaatcacagaaaagtatctcctcatttgtttgggatgagttttaattcagaaacaatttatagtaatattctaagagactgactgaatttgctttcccaactgaaaaaggaatcaactatttgttattatttaatgaagctttgaagcatgaggragtcaattattcttcagtgcagtgatgtacaaaggggactcctgcattttccctgttccctgaagagattaagaacttctgagtggagncaaacgggaaanatattgtttgtgga

SEQ ID NO: 18027 - DNA, 181 bp, Homo sapiens
aagttctacctagttctgccgctttcactggctgtgtgacctcaggatacttagtctctctgggcctcagtttctctacctataaaatggaaataatgatacccacctcctagggctggacatggaatgaaatgagttatacaaataaaaatttaaactataaaaaaaaaaaaaaaaaaaa

SEQ ID NO: 18028 - DNA, 187 bp, Homo sapiens
aagttctacctagttctgccgctttcactggctgtgtgacctcaggatacttagtctctctgggcctcagtttctctacctataaaatggaaataatgatacccacctcctagggctggcatggaatgaaatrgttatacaaataaaaatttaaactataaaaaaaaaaaaaaaaaaaaaaaaaaaa

SEQ ID NO: 18029 - DNA, 425 bp, Homo sapiens
ctcatgggtgcagctgccgccacccagccctggctgcagacccaggcatccctgcactcttggaggtccgggaagacccctttcccccatagtctcagaagtgcctgctcccactgcctggactctccaagctcccggctcctgctctgattttggagcaaagtcgaagctgagcctgggcactattgcaamctggstgggkttkgcamaccttggggtggtgctgccatgccagcttcctaccatcttggccccctctggactttgggtgccagtgagcacaggagggaggccaaaggggtgctgagggtggctcagcatgggcctgcaggtgcccctgggcacagaacaactgggcgtcatggacaacatgattgatggtgacaagaggcagacaggctcctgggtggaaaggggcaggtctc

SEQ ID NO: 18030 - DNA, 131 bp, Homo sapiens
caaacaagttaagggcaagattcttgccaagagaattaatgtgcgtattgagcacattaagcactctaagagccgagatagcttcctgaaacgtgtgaaggaaaatgatcaaaaaaaaaaaaaaaaaagct

SEQ ID NO: 18031 - DNA, 521 bp, Homo sapiens
acaagcatcgtagagcatatcatactatttataccgataataaaggtacatatgttgtcattaataccacaagaggttgtcagaagactctagaactgtgctaatatggtaaccacatgcggcttagtaaattgaaattaacagattagataaaatttaaaattcagtttttcaagtgtataccagacacgtttcaagcactcagtagtcatgaggcctgtggctaccgtattaatagagacacagaacatttccatcatcatagaacattcttttggatagcactgttctacaagtgttttgttaacagtatcgtcttggacctcatgttcatagccacttttgtggttcctaagtcaacaccttttttgccctgagtgtcattaaaggggttgttaagaagtacttttgggtcttctattaaaactaaaaaacaaaatgagaaaaataatgggagaagaggaaaagttgaccagagaagggtaagaaagtttgcatagtggagatgggtagaggagcac

SEQ ID NO: 18032 - DNA, 424 bp, Homo sapiens
cactcatttcagacaattgccattttagatattgctatcgccatcttttgcaattaagtttcaaagttatcatcatggcatttttaatatttagaaatttctttttttatctctggctttcagttgaagactattcaccccggtggactcatcatgttggggactttcaattgctactttaaaaagaacgcttcactgaaataggtctcatcccatcaggaacatagaaaaacaagcagcaggccgggcgcggcggcacaggcctataatcccagctacttgggaggctgaggcagaagaatcgcttgaacccaggaggcggaggttgcagtgagccgagatcgcgccactgcactccagcctgggcgacagagagagactctgtctcaaaaraaagyaaaaaaaaaraaaaaaaggaaaacaa

SEQ ID NO: 18033 - DNA, 474 bp, Homo sapiens
  misc_feature 16: n=a, g, c or t
tttctccykscyysgncyyccmarkwrsykggrmyksmrgssscykscmmcmmskycsgsykkttttttwawwwttttkgkwarrrmsgggkttymmcskkktkscmagrwkgkyyysrwyyycykgacyymwkrwycssccmmytkgggsmwtttwmmrrrkksykrwtkgkkkkkttwmmaamcyttwrsywmmmmrraaaaktyyycmmsktmccmacccmmccmrrarsccmrscmrsytymmcyyyymmykggrmywwwrggmwkrmywmykkksmwkgscmwkrawwarkttyytwawyyttyykrmccyymrkttycmmmwysrwwrgsmwtargawwmcywwyyymaarkkkymwwaaaarggwtwaawactktctgtgaaaatgtctcatgtctgtaatcccagcactttgggatgcmarkyykgrrgrwycyttkragscmrgrrktcgagagcagcctgggca

SEQ ID NO: 18034 - DNA, 191 bp, Homo sapiens
attgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgatttttttttttttttttt

SEQ ID NO: 18035 - DNA, 206 bp, Homo sapiens
agagcaatggggacgggcagggacagagctgcgggctgaggttcctccgttcggcgaasccttctctctgcccccgcctgctctgggctttcttggctatgtctgctcctgacaggagggatgtgtgttgccaggggtgggggcttggcgtgtgtgcgtgtgagaatatgtgtgtgtgtttaaaatacaaaaaaaaaaaaaaaaag

SEQ ID NO: 18036 - DNA, 381 bp, Homo sapiens
agtctgggtgttgagttccgggaccggagttcccgggccttttggcttctgtagtctgtacctttttaagcagtggaagtgcctgggtggattctccaatgctttattgttttcttgttacaattatttattttacttcccgtgatgtttcagcctcatcccttcaccatttgttgttgttgttgtttttgagacggagtctcgccattgtactccagcctgagcaacaagagtgaaactccatctcaaaaacaaaacaaaacaaaacaaaaaacaaagaagccatgtttacccactacctagcttctgtcttttcttttaatggcacttattcttccctctgctccttaaaggtaagcaaccttctagtttcagtgtggg

SEQ ID NO: 18037 - DNA, 208 bp, Homo sapiens
agtagagtccagagcggggaagcggcgcctgcgcagagacatagtgaccgtccgctcgccgccccgcctctgccaagccgcgccagcagtgaataacgagccagcagagacagcgtctgcgcascgtggctgaggagcctgtgsgcasggcgatggaaccagcggasagccgagckwgttagtgtcagccgaggggccgaaaccggaa

SEQ ID NO: 18038 - DNA, 67 bp, Homo sapiens
ataattcgaataccagggcaggccgagccagccgtgcgccgcgctccagggcccagggcgccgcaca

SEQ ID NO: 18039 - DNA, 145 bp, Homo sapiens
cgattctaaatttgttagtaatatattttattcatgcactctacttacaatagatttcctgcttgacatttcttagacatatcactcatgatcccacagttgctctttgaatgggtgcgaaacctgtgcaaaaaaaaaaaaaaaa

SEQ ID NO: 18040 - DNA, 389 bp, Homo sapiens
atttacacagggcggtggcgacggcggtggtggtgatggtgacggtgctgtgctacaggtcaagcgattctcctgcctcggcctcccaaggaactggaaccacaggcgcgcgccactgcsccaaggattttcacttttaactgtacagtgaagcacagacttctgagccagactgcttggtctgaactctggtgtcaccacttaaaaacaacaacaacaacaacagaagagaaaacccaaaagagtgaaaaataagaaagaaaaaaaaagctcccgcaagaggttcttctccctcccccccaccatgcgaatttgcacaccacgggaccacagcaggtttacagaatgcaatatacaatccacgatttataataaaacagtatatacaa

SEQ ID NO: 18041 - DNA, 245 bp, Homo sapiens
ttaatatcccatttctagttcgttattatttaagtaatttgcaagtacattctcattttaaaagattaaacgaaaggaacatgtaaagaataaagctgggggctgggcttggtggcttatactggtaatcccagcactttgggaggctgaggcgggtggattacctgaggtcaggagttcaagacccgcctgaccaacatggtgaaacctgagtctactaaaaatacaaaaaaaaaaaaaaattt

SEQ ID NO: 18042 - DNA, 406 bp, Homo sapiens
actgcaagctctgccttccgattcacgccattctcctgcctcagcctcctgagtagctgggactacaggcacccgccaccacgcccggctaactttttgtatatttagtagagaaggggtttcaccgtattagccaggatggtctcgatgttttgaccttgtgatccgcccacctcggcctcccaaagtgctgggattacaggcgtgasactgcgcccggccaaaaatggttgagttcttaatttaggattctttgccattagcccacagatgtctgtgacatatttggcgsctcaccttcaatcactggggggattctgagccttccctattattgaaatggtgagtatcatatgttccagaattaaccaggagacacaagctgtacatgctcatgcacgtatct

SEQ ID NO: 18043 - DNA, 462 bp, Homo sapiens
  misc_feature 382,425: n=a, g, c or t
actgcaagctctgccttccgattcacgccattctcctgcctcagcctcctgagtagctgggactacaggcacccgccaccacgcccggctaactttttgtatatttagtagagaaggggtttcaccgtattagccaggatggtctcgatgttttgaccttgtgatccgcccacctcggcctcccaaagtgctgggattacaggcgtgacactgcgcccggccaaaaatggttgagttcttaatttaggattctttgccattagcccacagatgtctgtgacatatttggcgccctcaccttcaatcactggggggattctgagccttccctattattgaatggtgctttgcttcagtgaataagccaactggagcggtggcnaatggtgggtgctactggcacccccttcgactacatcagcacnaagacatgcttttgtttgttgtgtctttaaaaatctt

SEQ ID NO: 18044 - DNA, 91 bp, Homo sapiens
  misc_feature 63: n=a, g, c or t
gcttagtcattgtcttccaggaaacagctccctcagtttggaatcagctctcccgctgcggsngcagtagccggagccggagccgcagcca

SEQ ID NO: 18045 - DNA, 86 bp, Homo sapiens
acacttcctgccacagtggtggctagagaagtacagacagagtataatggagacctctagcctctaatcatgggcactaaagggga

SEQ ID NO: 18046 - DNA, 433 bp, Homo sapiens
agatgggggtaggagctctccagacagtgtcccctcactcacccccgcggcgcctggcgtcttctcctgggtgttgaagtacaagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgacc

SEQ ID NO: 18047 - DNA, 400 bp, Homo sapiens
agctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtasgagtttagtgacgtggagcaggcgcagaacagtcggaggtgcctgagtggttattaaaaacgatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaag

SEQ ID NO: 18048 - DNA, 106 bp, Homo sapiens
cggatactttactcaataagcatttcccctggagtgtccgtgccctggtgttttttatcgatacgttgattaaaacgcgtggttccccgtgtgcctgaagcagaaa

SEQ ID NO: 18049 - DNA, 318 bp, Homo sapiens
ttcatttggttttttacatgccgttcctcaatccatttggaattcatttgggttgtaatataaggcaaggtcttgcttttgtttttttatttcctgtacagctggtttccccaacatttgtggccttttgctatgcgatctggtcatttttttttaaataatgcaagtttttggccgggcacggtggctcacgcctgtaattccaacactttgggaggccgaggcaggcagatcacctgaggtcaggagttcgagaccagtctggccaatatggcgaaaccccatctctactaaaaatacaaaaaaaaaaaaaaaaag

SEQ ID NO: 18050 - DNA, 363 bp, Homo sapiens
agtctggcgtcatctaggtcgctgctcagggaaatgcggaggccagtaggcttacgtgtttaccgcgtagggcaaagccttgccaaattcccggccagcggaggccgagggtggggactcacgggaagttaaacagcctcgtcggcgtcctcgaggctccaaaaccaggctctaggcggggacgactgcagccgttatggaggccaccgcggctacggccgsktttgaggcctccccaggtggagcggtggcctggagggkaatcttgatcctgggccagccacctgtcaagaggaggcggasgtcatgcctctggaagactggatgaatattctccaggagccctgacgaaggcgtgagtaa

SEQ ID NO: 18051 - DNA, 235 bp, Homo sapiens
  misc_feature 104: n=a, g, c or t
agtctggcgtcatctaggtcgctgctcagggaaatgcggaggccagtaggcttacgtgtttaccgcgtagggcaaagccttgccaaattcccggccagcggasncgagggtggggactcacgggaagttaaacagcctcgtcggcgtcctcgaggctccaaaaccaggctctaggcggggacgactgcagccgttatggaggccaccgcggctacggccscttgaggcctcccca

SEQ ID NO: 18052 - DNA, 454 bp, Homo sapiens
cagatataatccccttcttggtggtctcattgagccttagctcaatgtaaaagtgatgcatcttaaaacctattttaataaattttatataaatataactatatataaaaaactataattttatataaaaattcgttttaaaaaagttaactaggctgggcacagtggctcacgcctgtaatccaagcactttgggaggccaaggcaggcagatcacatgaggccaggagttcgagaccagcttcgccaacatagtaaaaccctgtctctactaaaaatataaaaaattaaccgggcgggtgttgcgtgcctgtaatcccagctactcgggaggccgagacaggagaatcgtttgaacctgggagacaaagatttcagtgagccaagatcacgccactgtactccagcctgggtgaccgagtgagcttctgtctcaataaataaatcaataaat

SEQ ID NO: 18053 - DNA, 477 bp, Homo sapiens
aagaaagaaagaaagaaagggagagagtgtagatgtcttgatgagtccctaagtagaaacacgaagagaaaaggaactaaaagaggaagccacggccaagagtggagcattacaatgttaagacttctagtatggagcagcacagttaggggtatggacaagtgcaagtcttggagtagaaagcaaagaactctgttgaatggaacgtggccacaccataccttggtgtgatctcaggttttggataggttggctgtagatagtcattgaatgtgggagaacagcctagagagctattaatgacagaaactgacaaatagaatgtagaatattagcttgtgaggaggaagggtttggagtaacaggaaagtagtcattgagtatgtgaggagctaggagaacatggaaatctttcttctcctacagcagtctctatctgaaaaaccatcagggagatagtttattcagaaaatagtt

SEQ ID NO: 18054 - DNA, 179 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaaaaaaaaaaaaaaaaaaaaaaaaaaaaa

SEQ ID NO: 18055 - DNA, 74 bp, Homo sapiens
aatccggtttccgctttcggtgcgctcacggggccgtgccaccgtctctacgtgagcgagacagctccgtaacc

SEQ ID NO: 18056 - DNA, 125 bp, Homo sapiens
ctgttgcccagcgcgggcccgttgaggcggacctcagttcccggccaggacacggtctgggccgccgaatctccggccgaagagcggcggcggcasggamccgtgagcagaggagccttgtggaa

SEQ ID NO: 18057 - DNA, 167 bp, Homo sapiens
attattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaaa

SEQ ID NO: 18058 - DNA, 153 bp, Homo sapiens
  misc_feature 153: n=a, g, c or t
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaan

SEQ ID NO: 18059 - DNA, 477 bp, Homo sapiens
accacgcaggggaagagaaagcaggagccgtccagcacggaggaaggcgaccatggccaaggagtggggctacgcagtcacaacggtcctgaccactggcatgaacttttcccaaatgccaagggggaaaaccagtcgcccrttgagctgcatactaaagacatcaggcatgacccttctctgcagccatggtctgtgtcttatgatggtggctctgcaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagttcatttggttcactggaacccgaagtataacacttttaaagaagccctgaarcagcgcgatgggatcgctgtgat

SEQ ID NO: 18060 - DNA, 552 bp, Homo sapiens
ctctctctctgcctgtcctagtcctctagtcctcaaattcccagtcccctgcaccccttcctgggacactatgttgttctccgccctcctgctggagtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggkgggtcagaacaccagatcaacagtgaagccacatttgcagagctccacattgtacattatgactctgattcctatgacagcttgagtgaggctgctgagaggctcagggctggctgtcctgggcat

SEQ ID NO: 18061 - DNA, 436 bp, Homo sapiens
tttggctcttcgggtaaagatggcggacgrcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggcccgattacagagtgcttgtgcacagagctcgaaaactagctcaacaatactatcttgtgtaccaagaacccattcctacagctcagctggttacagagagtagcttctgtgatgcaagaatatactcagtcaaggtggtgttcgtccatttggagtttctttacttattttgtggtt

SEQ ID NO: 18062 - DNA, 195 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaagaaaaaaaaaaarraaaaaaaaaaaaaaaaaaaamccaaaaaaaaaaaaaaaaar

SEQ ID NO: 18063 - DNA, 364 bp, Homo sapiens
agtacggcaaatatggcggasatcstgttgaatcttcaagtccaggaggttcagcatcatcagatgaccatgaatttgatccatcagctgacatgctggttcatgattttgatgatgaacgagcattrgaaagaggaagmaatgatggaaggrgaaacaaacttcagstctgaaatagaagatctgtcgtctgttcaggatttgaaaaagwagaggmwgaaaaccttawcacggaagtctgcatcaaagtaaagttcttctgaagtgctgctccatgtttcyaccaaatgaattttttttatcctcctgactcttcaggccaggtagcagcaaatagcamatgaaaaagtcagctacaaaagtt

SEQ ID NO: 18064 - DNA, 443 bp, Homo sapiens
atcagaattgtgtccattttccaggaacagaaaccaatgaaacagacttaagaaaaagaaaagaaattatggaccagtgtaactgagatagggagtcggaggaggttggcagaatcttcccttccaccatttttccaggtggctgtgttctcatggggccgccttgagcgtctgtcctccctgccaggcagtcccagtagaggagtctgttctgacccctggctccagcagaagtcccaggattctgaggccgggcatggtagctcatgcctgtaaccccagcatttcgggaggccaaggcgggcggatcacttgaggtcgggagttcgagaccagcctggccaatatggtgggacacatctctactaaaaaatacaaaaatcagcagggcgtggtggcacacgcctgttaatcccagctactcgggaggctgaggcaggaga

SEQ ID NO: 18065 - DNA, 109 bp, Homo sapiens
cggatactttactcaataagcatttcccctggagtgtccgtgccctggtgttttttatcgatacgttgattaaaacgcgtggttccccgtgtgcctgaagcagaaaaaa

SEQ ID NO: 18066 - DNA, 160 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaarraaaaaaaaaaaaaaaaaaaaaaaaaaaaaaaaaagr

SEQ ID NO: 18067 - DNA, 393 bp, Homo sapiens
ctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcagatcacaaggtcaggagatggagaccatcctggctaacacagtggaaccccgtctctactaaaaatgcaaaaaattagctgggtgtggtggcgggcgtgtgtcgtcccagctacttgggaggctgaggcagaagaatctattgaacccgggaggcggaggttgcagtgatctgagatggtgccactgcactccagcctgggtgacagagcaagactctgtctcaaaaaaaaaaaaaaaaa

SEQ ID NO: 18068 - DNA, 162 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaaaaaaaaaaaa

SEQ ID NO: 18069 - DNA, 54 bp, Homo sapiens
agaggagctcrgcctgcgctrsgcsacgatgtccggggagtcagccaggagctt

SEQ ID NO: 18070 - DNA, 427 bp, Homo sapiens
ccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaaaaaa

SEQ ID NO: 18071 - DNA, 160 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaaaaaaaaaaaaaaaaaaaaaaaaaaaaaaaaaaaaaaaaaaa

SEQ ID NO: 18072 - DNA, 450 bp, Homo sapiens
tttctgttctatttttttttaaccccaattatccttctctctctcctgcccccgcatcccactcccagggtgtcacgagccctgagctgcaatggcccgggcctgcagggcggggtaggggagggcaggggctcagcccgarakccagctcagtacctgaggggctgctctatgctgtgtatgcgcctctctggcatccgagacatcctcttggctggcgcttgctgcaggggggaccccccccagtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaaaaaaaaaaaaaaaaaaaaaaaaaaaa

SEQ ID NO: 18073 - DNA, 518 bp, Homo sapiens
gcgggacccgcgcggggaggggaaaccagcctcaaccgcctggcagcggcggtttcttctcttcgtgaaaatcgtgatctcatctctccgtccatgggcgaaaaaacagccatcaccaggccattcacgctttgtgcttttgttagcagagcccaggcagccctgcagcccacatctagggtacaaacggaacggcggcgttttccttgtatcatttagaggaaatttttgagctgaacagtattttttttctccctctctctctctctgaaatattgctgagatttaaaggaggacgaagacaacagattcatagctgggtcttgctgttttcctgacgctgaccacagcggatctaggtggctatttcgttggtgcacaggcgttcacagaggcagagaggggagaaagttgtcaaacagattcacagactgtcaaagtgcggcwtaaaccgagttcctgggctcctcactggcttcgtccacttaaacttttaacgtacacatgtagagagctga

SEQ ID NO: 18074 - DNA, 198 bp, Homo sapiens
atttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcastgcaggctgagaagcagaaggccagggaagaagaggagcaaaaaaaaaaaaaaaaagct

SEQ ID NO: 18075 - DNA, 120 bp, Homo sapiens
cggatactttactcaataagcatttcccctggagtgtccgtgccctggtgttttttatcgatacgttgattaaaacgcgtggttccccgtgtgcctgaagcagaaaaaaaaaaaaaaaar

SEQ ID NO: 18076 - DNA, 209 bp, Homo sapiens
  misc_feature 99,184: n=a, g, c or t
atttccggttccggtgtcagttcgaggcgccgcgccgccgccgcagccgccggagccgcaatgcctaaaggaggaagaaagggaggccacaaaggccgngcgaggcagtatacaagccctgaggagatcgacgcgcmgtgtsaggctgagaagcagaaggccagggaagaasbaggagcaaaanaaaaaaaaaaaaagyttatggatac

SEQ ID NO: 18077 - DNA, 304 bp, Homo sapiens
  misc_feature 209: n=a, g, c or t
aatgtagctttttttttcactttagcaacatgttggccaaaatgttgaaatactgcctagtagagacatcctttcaatgacgatgaagtgtaattttatttagtgatttagacatgtgacttacgaatttattttattttatttttttatttttttattttttggaacagagtttcgctcttgttgctgaggcaggagaatggcgtganccgggaggcggasttgcagtgagccgaggtcgtgccactgcactccggcctgggcggcatagcgagactccgtctcaaaaaaaaagaaatgtttt

SEQ ID NO: 18078 - DNA, 483 bp, Homo sapiens
aaaaatactatggatgtagcaataccaagaaggrtgttgcttcagaatgtctcctatgcacccaagaatcccaagttgcagatgaagcatcatatcattaaatattgggcttaagaagcctacaaatatccagaaaattctgtatgaatatagatcaagtgaacccttaaggaaatatttattctaaagggtcactttgaagaaatatccaatctatctgagtattcctaaactgagaaaagtagtttaactatatagaaatgtcaattgtagcaaaaactctataatttcaaaggggtatctatctccctattctttctggacatacagccagactacatttctcagccgtccttgcaattaggcatcgccatgtgctgaatttcagccaatgaaaggagagaagaacgtaataggagttacttctgaaaccgtgccccaaagagttaaagaaaccagtaactaacagaaattcttgagttt

SEQ ID NO: 18079 - DNA, 88 bp, Homo sapiens
cctcccggcgcagtcaccggcgcggtctatggctgcgacttctctaatgtctgctttggctgcccggctgctgcagcccgcgcacagc

SEQ ID NO: 18080 - DNA, 458 bp, Homo sapiens
ttcatgttttttctttcctttcctttagtatatagagaatagcatattcaatagaatgtatagctatctccataaagattaatgktatgttgaaatatatataactttaagggtgaaggatttttatcccatagaattatgatagtctttatctttctgtcaatccctttagaatatagttgttgcaacattttgcttctttttatctatttcccaattgagaatgtttctttatcatgttagaatcaagattttaaaaaaggccaggcgcagtggctcacgcctgtaatcgcagcactttgggaggccaaggcgggcggatcacgaggtcaggagatcggagccatcctggctaacatggtgaaacttgtctctactgaaaatacaaaatattagccgggcacggtgggcgcctgtagtccagctactcgggaggctgaggcaggagaatggcgtga

SEQ ID NO: 18081 - DNA, 512 bp, Homo sapiens
aaaatacccttggtaataaaaggcagtcaaggcaattcaccataaggaaagagtgtacaagatgttgcctcaagacctgaaaatgaatgagcatcatcccttaaagtgttaacacggaagcattaataaaccaagaacaatgagataaatcctgtttgcacatcatttccactgcgtcactcttccttgtctacattctgaagaaatcgcactgaaaacatgtctaaatattcatactctttttgagcttaaatttcagtggccaatttcatactatattggaaagttctgtctaataagagcctgacctgtgtatcctgtatagattttcgccagcaaagggtattgtcctgagtgccagcattttgggggatggtgaactgtatcagctgaggagctatagtctatcagttaggagcattattcctttgtcttggatatacttatgttcaaaagcaatttcttctccctcaagaactcattaaatgtattcaccraaaaaaaaaaaaaaa

SEQ ID NO: 18082 - DNA, 217 bp, Homo sapiens
  misc_feature 149: n=a, g, c or t
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcgncagctacgggttcgcggavmcccgaccccccaagggctagaggagcgctcggcggaccaaagaaagcc

SEQ ID NO: 18083 - DNA, 475 bp, Homo sapiens
tcttccggttgctaacggttcccaaacagcccccgaaaacgctacgtgagctgggccctgggcagaggagaaaacggacggaagaaaaggtctggccggctggagcgcattggtgcggtctcgggctcactgcaaccttcaccttccaggctcaagtgatcctcccacctcggcctcctgtgcagctgaactataggaatccctcagactgggttctccccctcttattctcctaaaggaaaagaagaatgatcatcaaaggcaaatggcagttgctatgcagcaacaccaagaactggcttcacgctccagagaaaatgctgtgcctcctcctggtggtttccggtgctccacatgttcaaagaaattacccggaaatgtagaaatgatccctgaaagtatagtcttccagtaatgtttcttttagcaaaaggatccaatctaagatctcatgtgttttagttttcttcaatgt

SEQ ID NO: 18084 - DNA, 114 bp, Homo sapiens
agcgamdttcctcagagtggaggcgggattcttaggggagagctcctcagcaattggttacatttgacggctttagtccagggacccagacgctactggataaggggtgaaatt

SEQ ID NO: 18085 - DNA, 220 bp, Homo sapiens
atgtctcccagaggaggcggagtcgaaacgtcatcttacggggcagaaaaatgtgaaaagagagactggcctagcctcccagcctacatctttctcccatcctggatgtttcctgcctttgaatgttggactccaagttcttcagttttggaactcggactgtctctccttgctcctcagcctgcagacggcctattgtgggaccttgtgattatcgata

SEQ ID NO: 18086 - DNA, 456 bp, Homo sapiens
  misc_feature 421: n=a, g, c or t
acttccggttgctaacggttcccaaacagcccccgaaaacgctacgtgagctgggccctgggcagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagcctcctgagtagctggagctacaggtgtgagctacccagcatggctcatttgagatttctgagtagagaagtaacatgattaaacttgggtattgagattattattttggctgctatgttaacagtagacttgaatgtgaaggggttgggcaagggcagaagcagggagacaggttggaaagttggagtgggaagggcctttttaagaataacacaancccctaaagacataaaactgaaaaggccatggagg

SEQ ID NO: 18087 - DNA, 335 bp, Homo sapiens
tttttgtttttmagctsacttsaagggtacctgaagcgaattggcaccaaagcagsagctgtattgccgcagttctagcttsaccttcmacgatgtttcccttggtsaaaagcgcactaaatsgtctcmaagttsgaagcattcagcaaacaatggcaaggcagagcaccagaaacgtacacctgattttcatgacaaatacggtaatgctgtattagctagtggagccactttctbtattgttacatggacatatgtagcaacacaagtcggaatagaatggaacctgtcccctgttggcagagttaccccaaaggaatggaggaatcagtaat

SEQ ID NO: 18088 - DNA, 407 bp, Homo sapiens
taattattcatattctcactattccacaaatgtctgtgattaacagattcattgtcaactttagttctcattctgcacatatgtaagttatgtttgtatctaatgtgaaattgtaatacagtcatccctcaatatgtttagggaattggttccaggacccccatgggtaccaaaatctgtgaatgctcagctctctgatatgtagaatggtgtagtatttgcatgtaacctatgcacatcctcctgtatactttaaataatctctagatttcttataatacttaatacaatgtaaatagttgttttattgggccaggcacggtggctcacacctgtaatcccagcactttgggaaatcaaggcaggaggattgcttaaacccaggrgttagagaccagactggacaa

SEQ ID NO: 18089 - DNA, 259 bp, Homo sapiens
caccttgttatctaggatggtttcaatctcctgatctcgtgatccgcccacctcagcctcgcaaagtgctgggattacaggcgtgasactgggcccagcccaattgcttactttaaaagtgtagagtggcatcaaatcagtaacctaatttactacctcaagaacctagaaaaaggagagcaaaatcagccaaagcaagcaaaagaagggaataataaagagcagaaattaatagaattaaaaataggaaaacaaaaaa

SEQ ID NO: 18090 - DNA, 87 bp, Homo sapiens
aatttcagcagcgggagaagatggacaagagaaagctcgggcgacggccatcttcatccgaaatcatcacaaaaaaaaaaaaaaaaa

SEQ ID NO: 18091 - DNA, 320 bp, Homo sapiens
acttccggttgctaacggttcccaaacagcccccgaaaacgctacgtgagctgggccctgggcagaggcagaaaacggacggaagaaaaggtctggccggagatgggtctcactctgtcacccagactggagtgcagtgagtggtgcgatcatagctcactgcagcctgaaactcctgggctcaagtgatcttctcgcctcggcctcctgagtagctggagctacaggtgtgagctacccagcatggctcatttgagatttctgagtagagaagtaacatgattaaacttgggtattgagatcaaaaaaaaaaaaaaaaa

SEQ ID NO: 18092 - DNA, 480 bp, Homo sapiens
aatttcctttggtctaaagtccaatttaagtccaacgtttctattgatgttctctcttggtgatctgtctagtgctgtgagtagggtgttacagtcccctactattattgtattggcgtcaaattctttctttcggtctggtaggatttgttttaggtgttccaaagttgggtacatatatatttagaattgttatattctcttgctgacaattgttatatcttcttgctctcaaatgatctctttatcattatataatgaacttctttgtcttttattacctttttgtatttaagtatattttatctgatatacatatatctacatctcttggttttgtttctgtttgtgtggaatatctttttccacccctctgcattcaatgtatatgtctttacaggtgaatttcttataggcagcatatagttgaataatgtttttaatcaattctgccaatctgcattttttaagtgggggatt

SEQ ID NO: 18093 - DNA, 426 bp, Homo sapiens
ttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcaa

SEQ ID NO: 18094 - DNA, 473 bp, Homo sapiens
gacaagcgtggccgcattagctctttctgcctcccacgcagccttatttttttttattgttgttttcttgttgctgttgttgttgttctcggagacggagtcttgctcttgctctgtcgtcgcccacgatagagtacagtggcgtgatctctgctcactgcaacctccgcctcctgggttcaaacaattctgcctcagcctccggagtagctgggattacaggcgcgcgcctgtaatcccagcactttgggaggccgagatgggtggatcacctggggtcaggagttcgagatcagcctggccaacatggtgaagtcccgtctctactgaaaatacagaaattagctgggcgtggtggcgcgtgcacctgtagtcccggctactcgggaggctgaggcaggagaatcgcttgaacccgggargccaaggttgcagtgaaccaagatcgtgccactgcacttccagcctggcaa

SEQ ID NO: 18095 - DNA, 448 bp, Homo sapiens
actaagcggccttggatacctggccgcgggatgctgggcggcgtcaggtgagcggtggtcgctgggcctcaggtaaccaaggagaaagagctgcggasaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatattt

SEQ ID NO: 18096 - DNA, 193 bp, Homo sapiens
tacagaaaaagttggttccgtcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaaaaaaaaaaaaaaaaaagct

SEQ ID NO: 18097 - DNA, 189 bp, Homo sapiens
aggggtgcaaagagtgtgggctgggagatcagctggtctgagttcaagctccaacaactgtttttcttagaaagaaaaaggagcaaatggagaaggaattattaagcagtatatttgacattgtctttttatataaatgttccactgaatttataataaatccatggagtgagcgaaaaaaaaaaaaaa

SEQ ID NO: 18098 - DNA, 411 bp, Homo sapiens
agtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggagcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacacsacat

SEQ ID NO: 18099 - DNA, 103 bp, Homo sapiens
gcacccctggacaccagaccggactgttcccgacccggagacgcggggccacagccccagctgaccctaatttattctcagcaccacyccctcccaggtcatt

SEQ ID NO: 18100 - DNA, 312 bp, Homo sapiens
ttacaccatttgttcttgctcttgtagttatgcaatttaattaaatattatattgggaggctaaggagggcggataactaggtcaagagatcgagaccatcctggctaacatggtgaaaccggtctctactgaaaatacaaaaaaattagcagggcgtggtggcgggcgcctgtactcccagctacttgggaggctgaggcaggagaatgaggtgaacctgagaggcggasttgcagtgagtagagatggcaccactgcactccagcctgggcaacagagcgagactccatcccaaaaaaaaaaaaaaaaag

SEQ ID NO: 18101 - DNA, 441 bp, Homo sapiens
aaaacagcccccgaaaacgctacgtgagctgggccctgggcagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagccwcctgagtagctggagctacaggcctctgacaatatgatactaagccatcatagcccctgtgaccgccacgtatacatccagwtgacctggagcaactgaagaaccacaaaagatggcattccaccattgagatttgttcctgccccaccccaactaatcaatcgaccttgtgacattscccctgcccccggacagtgagtctcatgatctccccacccagcaccttggcaccttgtgacccccgcccctgcccacaa

SEQ ID NO: 18102 - DNA, 63 bp, Homo sapiens
tctagccccgccaccttccggaccagacacctccccgctgctggctccagcccttccccgcgt

SEQ ID NO: 18103 - DNA, 396 bp, Homo sapiens
agttgcaccacgagcgctgcggacactcggggcggcagtcggtctgtcagtcctcccgccaggtttacgtggggcttatcaagtatttactaargcaacktycwagaagcttggaaagggctacaagccatggtccctgagcccaagacacttacaggtttgctttctgggaggattrgggtggattagagactgccttccagtcagtgaccacaggatgggccatcttggtctctgtccgtatctggtttgggggttttcgcaggactaggcctaggctaaggacagggagggcacaagttctggctgggtacgaatgcaaccccatggcctacgtcatggagaaggctgggggaatggccaccactgggaaggaggccgtgttagacgtcattc

SEQ ID NO: 18104 - DNA, 64 bp, Homo sapiens
aaatttgacacctccgggcttggaakcagctctctcctccttccccgctgsttataaacctcar

SEQ ID NO: 18105 - DNA, 458 bp, Homo sapiens
  misc_feature 250,254: n=a, g, c or t
atcgaccacggaaatttgacacctccgggcttggragcagctctctcctccttccccgctgcttataaacctcagccctgatgctccagctcactctaccccatctccttgccgggtcagccctgacaaaggtcagctagccccttgaggacatcagctttggcctcagggtcctaatggcagcagaascrctgacagagctagaggagtccattgagaacgtggtcaccaccttcttcacctttgcaangcangagtggccggaatgatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcakgaagaagaaagaccttaa

SEQ ID NO: 18106 - DNA, 459 bp, Homo sapiens
tttttttaaagaatgtccaaaccagagcgagtggctttccaattactctccctgaactaggccttcctactcctccgacccccaactcaccattgatcgcgatcctggcccttcccaagtcaacagattcattctcatagaagggcatcagaggaagataaagaaggatcctcaatgtcagacatctgagcccaagctaagccatcataatccctgtgacgtgcacatatacatgccccactccaactaatcaatcgaccttgtgacattcctcccctggacaatgaatctcatgatctcccaaccctgcaccttgtgacccctcccctgcccacaamgagataaccacctttaagtgtaattttccactasctacccaaatcctataaagctgcsccaaccctatstccctttgstgactctttgtggactcagcccacttgcacccaagtgaaataa

SEQ ID NO: 18107 - DNA, 620 bp, Homo sapiens
atcatgacactgaaaagtgcttctattgatcaagaatgggattgaagattactaaaattgaaataatatcaaatggttatgaacttctgaatctacccaactaaaccctcctactctcttaaagaaaatagtggatggctacatatttggatgcacaagtcaaccaaccacagtatcaatgtttgatttactctcccactatgatcacccatcttcatagcctcatggtcactgctccaaatctagacttgtggtttggctgcatctcaagacttgaaccataaatgtcaatataaatgcacattttctagaaggatgacaaaattcaaaacattctattttcaggaaaataatgtgcaaacatatcattataatatccttttatctacaatttataaaactctggtcaaaatgtttgtctaaaaaaattcctggcaggatgctgatatgagcctccaggctctctcatctttaacataggcaattcatcaggctacacacaaaagcacccaaaagtctgcaatggttctctttaaataaaggcttgaagcacgcaggggccttttgtagaaagagaaatagaggagatcccaaggtcggggtgctgtacacagaagaag

SEQ ID NO: 18108 - DNA, 825 bp, Homo sapiens
gagaggatcaacaatctccccttattctaaaaaagcatattggaatggtatggcaaaccttgcctcgctgcttctgcatctggtttgtgtgcttctaggaagtgctttttttgtcaggacctggtctgatttacccttgggaagtttgatcttgtgggaaacctcaagatgctgagctgatatgcatttcctatgctttttataggatcagattggtatcatgcaaggtgttttaaaaattaggaaattatactatttattttgcttatgcaaccttgtataagggataaatggaactcagaattttggttattgaagaatgagcctcactccacttactaaatgtaagactgagtaaggaagacttaaaaagtgagtgaaattgctgtgaaaaatagagatctggaaaaaaaaatagaagttactgaagagcttacacacttaatttgatcacactgccttttctcagtggaaaaaaatgaattaagtaatccttatttgatcatttttcggtgtttcgaatggagctttagaaagtaatagtttaggccgggcgcagtggctcactttgtaatcccaatactttgggaggccaaggcgggtggatcatgaggtcaggagatcgagaccaccctggctaacacggtggggccccatctttactaaaaatacaaaaaactagccagttgtgtgcctgtggtcccagctgcttgggaggctgaggcaggagaatgccatgaacttgggaggtggagcttgcagtgagtcaagatcgcgccattgtgctccagcctggccgacagagcgagactccatctcaaaaaa

SEQ ID NO: 18109 - DNA, 96 bp, Homo sapiens
gtttgttactttcacactgttttctggtctacagcaaattgtatctactatcattccgttgtattaagaatgggtctcactttgttgctccaggat

SEQ ID NO: 18110 - DNA, 553 bp, Homo sapiens
acactgttttctggtctacagcaaattgtatctactatcattccgttgtattaagaatggtaaattattcttcctcctttccctctttccctaatcaaacacttaagtctgtaaacatcttcatgaagttccttctgtgagttttaactggagattaaacctgaagaaggggattagaatgatctcaggaagtctttcagtggaaggttgattcaaactccgaactttctgtctgcttcccttcattgtgggccaccgtcgataaaataagaaacatgtgccctagttaaatgtgaatgcctcagtgtaacagcgaaccccctgctgctggacagccctaaactgtttaagcctgtgtgtcccttgatttcatgggagactctgcgagacacaatcctgctgatggccaaaccacagcgacagtctctccaacaaggtagacgttggatttatggtcagaacagtgctcttgggggccattaaagtggcaaggtaccagttttggctcttcacttttaagtcagtacaaattatggatgatcccatctatgat

SEQ ID NO: 18111 - DNA, 482 bp, Homo sapiens
tagcattcatttaatcttcatataaagcatataaaatactatccccattttaccgatgagaaaattgaaatttagaatgttgagtaatttcccaagctattaatctgggattcaaaccagatttatctgatttccaagtccagatattcatttattcattcaacaattattcagtactacctatgtgccagatgctgttccaggcccaaatggccatggttataaactaatcagacaaaataatgccctcatgaaacttatagtctagtggaaaaggtagataataatgaagtaaattaattatacatatatttaaatatactgtataataatgtatgaattttacacatatatcatgttaaataatgaaaagtactggccgggcgcgatastcacgcctaatataccagcactttgggaggctgaggcgggtggatcgcctgaggtcaggagttcaagaccagcctggccaacatggtgaa

SEQ ID NO: 18112 - DNA, 424 bp, Homo sapiens
attttgttcgcgcggaasgscggtagggtgggaaccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcggttgccctttaaaaaccccccgtgtggtcctccctggaagtgttacgtgtggctcgggcacaggaggcgtgtcaccctgtgcagtgcacacactggctcctctgtctttgcaaaaaaaa

SEQ ID NO: 18113 - DNA, 507 bp, Homo sapiens
  misc_feature 452: n=a, g, c or t
atctcggagttcttcccatgtgcaaggcagggtgctgagcctgtgatgcgtatgtatgaagccgtgtcatgctcaccactcccctattgagcagtgtgcgatccccaacctctgatgttacacggaaccagctacccaacgagttgttttttacatttcccttttggtgttctatttatctggccttaaacaggcctggctgagaatatttaaaatcagagaacgcacggctggacacaaggcaaaccgtattccacacgcgcatttgcttaggagcagagttcagcaacgtgacgctgcctcccaagggcttgggttgttcccccatcctctctccacgactccgtcccaccttcccagtacttaaaagacgacggcagtaaccaacaatgaatgccccagctcaggagagcagctttgtgaccgcaagccacggcttccaggagcctgangagggaaggtcagccctgaggagggaacagcacaagccaggctcgcgtgttgaca

SEQ ID NO: 18114 - DNA, 374 bp, Homo sapiens
aaaaaaaaagtcctagctagggtcccaagtgacagccagcatcaactataacatgtaaaggagccagtcttcagatgattccagcctcagccttcaggccactcagctggtgccaaatagagtagggatgagctgtccccacagagacctgcccagtgcacattgtgagaaagccccagaatgttgacagtcgctctcctagcccttctctgtgcctcagcctctggcaatgccattcaggccaggtcttcctcctatagtggagagtaaggaagtggtggtggaaagcgattctctcattctggcaaccagttggacggscccatcaccgccctscggtccgagtcaacacatactacatcgtaggtcttcar

SEQ ID NO: 18115 - DNA, 497 bp, Homo sapiens
aaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggwagagcacatgttggtctcctcttagtgtgaa

SEQ ID NO: 18116 - DNA, 467 bp, Homo sapiens
ccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagtttttattaaaggggaggggcaaatattggcaattagttggcagtggcctgttacg

SEQ ID NO: 18117 - DNA, 226 bp, Homo sapiens
caggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttgaaacataatgtgatcatgctctaacttcaatataccaataaaataatcagcttgcaaaaaaaaaaaaar

SEQ ID NO: 18118 - DNA, 394 bp, Homo sapiens
  misc_feature 169: n=a, g, c or t
aacatttcaaatggcatgtttctgggctttgggatgtgggaagctggtgagaaggcacactctctccacagttagatttgggaggaggcctgacttgggagagggatccaggctcacaccgccctgtcctgtgtcctgactgcagacagaggaactgaaccgcgagtgnccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagc

SEQ ID NO: 18119 - DNA, 509 bp, Homo sapiens
acattgctcagaaaarccccttgtgcccctttctgccatccgcgctgtctcgtgtctccctttttccattaaatgcctcttttcttgcgggtctcatgtcgggaatagtgcactacggggacatacctatccccaactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggagsccgcctgttacgatggtgtcatgagtttcaa

SEQ ID NO: 18120 - DNA, 403 bp, Homo sapiens
accccactctcacgcacgcccccaccctgcactgatgactattgggaacaccctggccactgccaatggaatgatcgagctctactggatgcctttgcatttcaaaagagaatcatgttgattcttcatgagcagtgtcagatgagtcacctgcaccattgacacaatgaagggaacatctctgcatgagactagccatctacattgcttttcaatctcacccaaaagacggttcaaagataagtgttagagaccatggctttggagttcaaatgctctggattcggacatatgttctgtcatgacaattctgtgcaagttttggcaagtaacctttcacctctgtcaacctctgtttccacctatgtaaaatgagaaaaataaaagtattaacctcacaaaa

SEQ ID NO: 18121 - DNA, 493 bp, Homo sapiens
agcaactggcccaggtgccgttccctgctgtgaaggtttgttctttctgtcttcacaataaatcttgctgctgctcactttttgggtctgtgccacctttaagagcctgtaacattcaccctgaaggtcggtggcttcattcttgaagtcagtgagaccaggaacccaccggcaggaaccaactccggacacagcgccactgcactccagcatgggcgacagagcaagactcagtaaataaataaaacaaaaaaagcatgcacgcacaaagcaacaaaaacgtttcaaagaacatcttgaaatcagccgggaaggagaaaaacacaccaaacgatgatataattgatgatgatcttctgataacaaaaaacaggctctaaaacaagggaatgggatccgtaagatttaagagtgagagagagaataaaacttctgaaaacatttctgttttataccaacgaaaataccattttaaaatgagggtcaagtaatg

SEQ ID NO: 18122 - DNA, 62 bp, Homo sapiens
ctcgcgtggtcgctgggtctgcgtcttcccgagccagtgtgctgagctctccgcgtaaccac

SEQ ID NO: 18123 - DNA, 366 bp, Homo sapiens
agtgacggatgttgagaaatggaggagccaatcactattgtagccccagactaacgcatagctagccaactgtcaggcatgtaagtgaggccatctttaaccagaaaacatgctttaaactgccacagaatgaagcctgccttgtttaatgtgttgtgtgaaatcaaagaaaaaacaggtatttcgaaaaaagcctggttttggtacagctcttccagaacccacgggaagaacctgttcatcagctcatccatccgtctgctgagtaaatgcttattgagcatctgctgaatgccagcactgttctttgttcttggaatacatcagtaaacaaaataagaaaaacaaaaccaaaaaaaaaaaaaa

SEQ ID NO: 18124 - DNA, 69 bp, Homo sapiens
ttttactcagggcacagagggtctctgcggccgtagcggcggggctgcggtascactttagatttgggc

SEQ ID NO: 18125 - DNA, 372 bp, Homo sapiens
tactgtgacagatggggaggagccccactgcatctggagtgggtcttggctggccatgtgaactaattaataccccagaaatcaggatacatgccgggcgtcggggcttacgcctgtaatcccagcattttgggaggctggggtgggtgggtcccttgaggtcgggagtttgagaccagcctgaccaacatggtgaagccccatctctactagaaatatacaaaattggcctgtggttccagctacttgggaggctgaggaaggagaattgcttgagcccaggaggtggaggttgcagtgggctgagatcgcaccactgcacttcagcctgggcaacgagagcaaaactccatctcaaaaaaaaaaaaaaaa

SEQ ID NO: 18126 - DNA, 412 bp, Homo sapiens
acacagcccacagagttccacctgctcacaggttggctggctcagcaaggtggtgccctgctctgagcattcaggccaagcccatcctgcaccatggccaggtacagatgctgtcgcagccagagccggagcagatattaccgccagagacaaagaagtcgcagmgaaggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcraaaaaaaaaaaaaa

SEQ ID NO: 18127 - DNA, 488 bp, Homo sapiens
atattattgcaagcctttgcacatctctttgtatcatccccctatgacatcatgtgttaatctcatctcaggactgcaacccaagattgcagtgagtgggaagatacaatttttacagcatcaccaaaaaggataaggttatttggtacgaaaacagcctgagaagatagataacacatacacaagatggacagatgttgaaagttgctgtgttctaataagactgtcaataaaaacaagtaatgcaaacacattttgagtttctcagctgagccaaaggaaatcaagaaatctcctggaatcaaggaaatcaaggaatcaattacttacaccaagctactcaagaggcagaggcaggaggatcacttgagcccaggaggcggaggttgccgtgagccaagatcccaccactgcactccagcctgggcgacagagacccccatgtcaaataataataataataaataaatccttctcagtccctccaa

SEQ ID NO: 18128 - DNA, 449 bp, Homo sapiens
atattattgcaagcctttgcacatctctttgtatcatccccctatgacatcatgtgttaatctcatctcaggactgcaacccaagattgcagtgagtgggaagatacaatttttacagcatcaccaaaaaggataaggttatttggcaaacacattttgagtttctcagctgagccaaaggaaatcaagaaatctcctggaatcaaggaaatcaaggaatcaattacttacaccaagctgagcaagagacaacatgaaggcagaggtagcagtaatcagacaggatttccaagggtctcactctgtggcacaatgatcatggttcactgcagcctcggccttctgagctcaagtgatcctcccgcctctgcctccgcctcctgagtagctgggactacagatgtgcgacacagcacctggcaaatttttaagtattttcttcagactga

SEQ ID NO: 18129 - DNA, 486 bp, Homo sapiens
aacccacttgggtcccattccatgctgkggaaggtttgttcttttgcacttcacaataaatcttgctgctgctcgctctttgggtccgcaccacctttatgagctatatcactcactgtgaaggtctgcggcttcactcctgaagtcagcaagaccacgaacccaccaggaggaacaaacaactctggacgcgccacctttaagagctgtagcaaccactgcgaaggtttgtgtcttcactcctgaagtcacgccagaccacaaacccactggaaggaagaaactccagacacatctggacatctgaaggaacagactcaggaaacaatctttaagaactgtaacactcaccgccaggttcatggctccattcttgaagtcagccagaccaagaagccaccagaaggaaccaattccggacacgggagcacagatgtaccctgaatatatgccttcgttacagaagctttttgaggtactggacac

SEQ ID NO: 18130 - DNA, 192 bp, Homo sapiens
aagtgagaccaacgttgtgaggtattaactcggaaccgtcatctatccttgtggagaaaaacccggagacttggattaggacccaatagtctaccttggcggcaggcctggatcttgaggaggaaggcacttctgaaatagctgcaactcccgtcccatggtgaccaagagaatttctccagaggctacctc

SEQ ID NO: 18131 - DNA, 314 bp, Homo sapiens
acttcactgacccctccagtaactgtttgtccaggcagttacaggatgcagttaacatgtccgttcacctcgcataacaaagctaacaaaaaacatctccaagatgcggtcaagacatctgtacccccgacttagctcccctaccctgactcagccctcctgcacacccaactcagcttccccatcctgacctcattccttgccctataaagccctgcagtagtctgtaagcggggctgcctcctctgcgtttgtcaggaggtagcctgacgggactgacaataaatcagcttgcctgaaaaaaaaaaaaaaaa

SEQ ID NO: 18132 - DNA, 519 bp, Homo sapiens
aaatagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaacggttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcaggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaa

SEQ ID NO: 18133 - DNA, 394 bp, Homo sapiens
cacagcattttagaacttctcatttgattaagaatcaaatatatacatggggattgtatattttctttcttttttttttctggagacagattgtsgcccagcctggagttcagtggtgtgatcccagctcactgcaacctctgcttcctgggtccaagtgattctcaacctctcaagtagctgggactacaggtgcgcaccaccacgcccggctaattttttgtatttttagtagagatggggtttcgccacgttgcccatgctggtctcgaactcctgagctcagacaatccaccgcctcggcttcccaaagtgctaggattacaggcgtgasastgcacccggcctgtatgttttcactaaatgggctgactgcatgatagccagggacatg

SEQ ID NO: 18134 - DNA, 68 bp, Homo sapiens
agtcgggggttcccggggagccatttttacttggctgtctcaccacagccagccccatgaagaggaac

SEQ ID NO: 18135 - DNA, 387 bp, Homo sapiens
  misc_feature 380: n=a, g, c or t
aaactcstgggctgcggcattsacgtgatctgcacgggcgcagatgtaggcaccggtccgagtgcctgssctctgtccccgcggctgggtctcgtctgctccggttcstgggstcstaattsttggtcmagcttcttcmaggtctgcgcgtctgttgttccsagcgctctgcgaasctgaaaaggaggagcaacctgtccagaatccccgcagacaggaaaaggaggggaaatctcgacatggaaaaactctacagtgaaaatgaaggaatggcttcaaaccaaggaaagatggaaaatgagaacagcsamaagacgagagaaagccagaagtaacttgtactctggaagacaagaagttagaaaacgagggaaagacanaaaacaa

SEQ ID NO: 18136 - DNA, 446 bp, Homo sapiens
  misc_feature 430: n=a, g, c or t
gattgctactttagtaataaataatagtaacttgtgttttataatgtagcagttaagatcaaaagatgcaacaggaaggtcctcacaagatggctgaacagatgcaggtgctgtgcctctggactgcctagcctccagaactgaggtgttggaagctgtgaatgtggatgaaagtaccaatatagagagaacagagtgagaatagaagacagcccaagaatctaaagtcatgcacttgcaagggagtcagaggaagagagggaaaatggttcattgtttccatcatgtactctatggaatacaaagctctgaaacctgttggctactggaagtgtacaagaaaaaagactctcaagctagaggtggggtagagctggagccagccatgtcaagatctttcgaggacatgaacattttttatgcttattanaaagatgatgtggttt

SEQ ID NO: 18137 - DNA, 445 bp, Homo sapiens
ttcctgcggcgtcggtggcgagctgaggtggaggcaggctgcggcagacggcgacagtggcggcggcgcatggcagggcttgcaggtttggatcgtctatccctttcagggaactggtgtgttggggacggcttctctgccctgcctgacatggtccagtcatcccgtcagccttctggacggcaacaccaaagctgggaccaaaaaaagttccagcttaagtgctaatgccaagtgttagatcttgtttgcttgtttgttttaaatcagagactaattaatgtcaagcaaatctgttaaaagatttgatcacgggaagcctggtcggtttccagtgaccaggtcaattccatatctgaaattagtcttgttagagttgctgccaaaaacagtttaacctttaatctgtaatatgttgtttcaaagaggaaaaaaaaaaaaaaaa

SEQ ID NO: 18138 - DNA, 410 bp, Homo sapiens
aacacttaattttgaatgatagtataggcaataggatattcaataagatttcagaaagaggatacagaatcacacacacacacacggaaaaaaaaaaggaggtggatcagttttgaggatgaatatctcacctttgttattgcacacaatggctccatttatggctcaaatctggcctcctgtctgtgacagagtgcagcacctgaccatcgtaaatactcaataactatcttctgagtgaatgacagaaaagactgctcttcttcccagaatgagaatcaacattccataggaataatatttcagaagctagacatggctttcaagttgtcagtagattttacaatgggccatacaggaacatcaaaatctggataaaacctaaaaaacaaaacattaatatatctggg

SEQ ID NO: 18139 - DNA, 356 bp, Homo sapiens
  misc_feature 9..10: n=a, g, c or t
agtgkkstnnaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagatgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaa

SEQ ID NO: 18140 - DNA, 72 bp, Homo sapiens
attacaatttccttctatactcagaggtcattactactcagacttttctggttttcgtcattacgcatgaaa

SEQ ID NO: 18141 - DNA, 336 bp, Homo sapiens
  misc_feature 64..65: n=a, g, c or t
agtgggcggaccgcgcggctggaggtgtgaggatccgaacccaggggtggaggcggctcctgcnntcgaaggggacttgagactcaccggccgcacgccatgagggccctgtgggtgctgggcctctgctgcgtcctgctgaccttcgggtcggtcagagctgacgatgaadbvtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatga

SEQ ID NO: 18142 - DNA, 352 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaatgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaa

SEQ ID NO: 18143 - DNA, 375 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaadwwtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaaaaaaaaaaaaaaaa

SEQ ID NO: 18144 - DNA, 352 bp, Homo sapiens
  misc_feature 173: n=a, g, c or t
agtgggcggaccgcgcggctkggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaa

SEQ ID NO: 18145 - DNA, 350 bp, Homo sapiens
  misc_feature 172,343: n=a, g, c or t
agtgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaawntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctnaaaaaaa

SEQ ID NO: 18146 - DNA, 344 bp, Homo sapiens
  misc_feature 1,173: n=a, g, c or t
nbtgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagtngatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctga

SEQ ID NO: 18147 - DNA, 353 bp, Homo sapiens
  misc_feature 84..85,173..174: n=a, g, c or t
agtgggcggaccgcgcggctggaggtgtgaggatccgaacccaggggtggaggcggctcctgcgatcgaaggggacttgagwynnaccggccgcacgccatgagggccctgtgggtgctgggcctctgctgcgtcctgctgaccttcgggtcggtcagagctgacgatgwhbnntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaa

SEQ ID NO: 18148 - DNA, 403 bp, Homo sapiens
  misc_feature 359..360: n=a, g, c or t
acagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagmgaaggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctghtnnggaacaatgccgcctgtcaataaatgttgaaaagtcatcccaa

SEQ ID NO: 18149 - DNA, 362 bp, Homo sapiens
  misc_feature 58,172: n=a, g, c or t
agtrarmggaccgcgcggctggaggtgtgaggatccgaacccaggggtggaggcggcncctgcgatcgaaggggacttgagactcaccggccgcacgccatgagggccctgtggtgctgggcctctgctgcgtcctgctgaccttcgggtcggtcagagctgacgatgaagnwgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaaaaa

SEQ ID NO: 18150 - DNA, 343 bp, Homo sapiens
  misc_feature 172: n=a, g, c or t
aktkkgsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctg

SEQ ID NO: 18151 - DNA, 365 bp, Homo sapiens
  misc_feature 2,172: n=a, g, c or t
antgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaraaaraa

SEQ ID NO: 18152 - DNA, 406 bp, Homo sapiens
agcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagmrataggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcaaaaaaaaaar

SEQ ID NO: 18153 - DNA, 357 bp, Homo sapiens
  misc_feature 173: n=a, g, c or t
aktddgsggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaagngatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaa

SEQ ID NO: 18154 - DNA, 340 bp, Homo sapiens
aktgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgacc

SEQ ID NO: 18155 - DNA, 360 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaabtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaaaaaa

SEQ ID NO: 18156 - DNA, 350 bp, Homo sapiens
  misc_feature 176..177: n=a, g, c or t
akttttwmggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaaktwnngatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaa

SEQ ID NO: 18157 - DNA, 348 bp, Homo sapiens
agtkkksggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaabhtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaa

SEQ ID NO: 18158 - DNA, 406 bp, Homo sapiens
  misc_feature 217..220,301..303: n=a, g, c or t
acagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaaagtcgcagacgaaggaggcggastgccagacacggaggagagccatgaggtgswgbmgcmnnnnggtacagaccgagatgtagaagacactaattgcacaaaatagcacatccaccaaactcctgcctgagaatgttaccagacnnnhagatcctcttgccacatcttgaaaatgccaccatccaataaaaatcaggagcctgctaaggaacaatgccgcctgtcaataaatgttgaaaagtcatcccaa

SEQ ID NO: 18159 - DNA, 348 bp, Homo sapiens
  misc_feature 171..172: n=a, g, c or t
agtgggsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaanntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaa

SEQ ID NO: 18160 - DNA, 361 bp, Homo sapiens
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctwaasgatgaadwttatgtggatggtacagtagaagaggatctgggtaaaagtagagaaggatcaaggacdhgatgatgaagtagtacagagagaggaagaagctattcagttggatggattaaatgcatcacaaataagagaacttagagagaagtcggaaaagttttactatgaatgaccctgaaaaaaaaaaaaaaa

SEQ ID NO: 18161 - DNA, 362 bp, Homo sapiens
  misc_feature 150,171: n=a, g, c or t
agtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcggncggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaraaaaaaaaaaaaaa

SEQ ID NO: 18162 - DNA, 349 bp, Homo sapiens
  misc_feature 2,172: n=a, g, c or t
antgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaa

SEQ ID NO: 18163 - DNA, 348 bp, Homo sapiens
  misc_feature 172: n=a, g, c or t
wbtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcgggtcggtcagagctgacgatgaantgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaa

SEQ ID NO: 18164 - DNA, 344 bp, Homo sapiens
aktgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagwtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctga

SEQ ID NO: 18165 - DNA, 353 bp, Homo sapiens
agtgggsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaagktgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaa

SEQ ID NO: 18166 - DNA, 354 bp, Homo sapiens
  misc_feature 7,173: n=a, g, c or t
aktrrrnsggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaadntgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaa

SEQ ID NO: 18167 - DNA, 347 bp, Homo sapiens
  misc_feature 170: n=a, g, c or t
aaaaaacagcccacagagttccacctgctcacaggttggctggctcagcaaggtggtgccctgctctgagcattcaggccaagcccatcctgcaccatggccaggtacagatgctgtcgcagccagagccggagcagatattaccgccagagacaaagaagtcgcagmgnaggaggcggastgccagacacggaggagagccatgaggtgctgccgccccaggtacagaccgcgatgtagaagacactaattgcacaaaatagcacatccaccaaactcctgcctgagaatgttaccagacttcaagatcctcttgccacatcttgaaaatgccaccatccaataaa

SEQ ID NO: 18168 - DNA, 356 bp, Homo sapiens
agtgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgwtgaakhtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaaaaaaaaa

SEQ ID NO: 18169 - DNA, 349 bp, Homo sapiens
aktgggcggaccgcgcggctggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaadwtgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagttttactatgaatgaccctgaaaaaa

SEQ ID NO: 18170 - DNA, 423 bp, Homo sapiens
  misc_feature 415: n=a, g, c or t
agcccacagagttccacctgctcacaggttggctggctcagcaaggtggtgccctgctctgagcattcaggccaaggccatcctgcaccatggccaggtacagatgctgtcgcagccagagccggagcagatattaccgccagagacaaagaagtcgcagmsaggaggcggastgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcatccctaaaaaaaaaaaaaawtnsgaaaags

SEQ ID NO: 18171 - DNA, 357 bp, Homo sapiens
  misc_feature 174,331,353: n=a, g, c or t
agtgggcggwsytgctksggstggaggtgtgaggatccgaacccaggggtggaggcggctcctgcgatcgaaggggacttgagactcaccggccgcacgccatgagggccctgtggtgctgggcctctgctgcgtcctgctgaccttcgggtcggtcagagctgacgatgaakntgatgtggatggtasagtagaagaggatctgggtaaaagtagagaaggatcaaggacggatgatgaagtagtacagagagaggaagaagstattcagttggatggattaaatgsatcacaaataagagaacttagagagaagtcggaaaagttttantatgaatgaccctgaaaaaaanaaaa

SEQ ID NO: 18172 - DNA, 86 bp, Homo sapiens
attacaatttccttctatactcagaggtcattactactcagactyttctggttttcgtcattacgcatgaaaacgccaccttaagc

SEQ ID NO: 18173 - DNA, 331 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaa

SEQ ID NO: 18174 - DNA, 705 bp, Homo sapiens
aatcagaatcagcaggtttgcagtcagattggcagggataagcagcctagctcaggagaagtgagtataaaagccccaggctgggagcagccatcacagaagtccactcattcttggcaggwatggcttctcatcgtdmtgdvtcctcctctgccttgctggakstggtatttgtgtctgaggcawggccctacgggcaccgggtgaatccaagtgtcctctgatggtcaaagttctatgatgctgtccgaggcagtcctgccatcaatgtggccagtgcatgtagttcagaaaggctgctgatgacacctgggagccatttgccttctgggaaaaaccagtgagtctggagagctgcatgggctcacaactgaggaggaatttgtagaagggatatacaaagtggaaatagacaccaaatcttactggaaggcaacttggcatctccccattcccatgagcatgcagaggtggtattcacagccaacgactccggccccccgccgcttacaccattgccggccctgctggagcccctactcctattcccaccacggctgtcggtcacccaaatcccaaggaaatgaggggacttctccctccagtggaacctgaaaggacgagggatgggggatttcatgtaaccaagagtattccatttttactaaagcagtgttttcacctcatatgctatgttagaagtcc

SEQ ID NO: 18175 - DNA, 178 bp, Homo sapiens
  misc_feature 42: n=a, g, c or t
ahtactactcagacttttctggttttcstcattacgcatganaacgccaccttaagcttatgtcgcctgtgaatatttaagggaaaaaaacatcccggcaaccaactgctaggcgacggacgctaagcacctcctccccgcggacgtcagcacccgccttttcccgaagtcgcaacac

SEQ ID NO: 18176 - DNA, 484 bp, Homo sapiens
  misc_feature 333: n=a, g, c or t
agcggcgggctcctgcagcggtggtcggctgttgggtgtggagtttcccagcgcccctcgggtccgaccctttgagcgttctgctccggcgccagctacctcgctcctcggcgccatgaccacaaccaccaccttcaagggagtcgaccccaacagcargraatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtngsmagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagc

SEQ ID NO: 18177 - DNA, 325 bp, Homo sapiens
  misc_feature 170,226,261: n=a, g, c or t
tttttgtcgcgcgaggttttggtttgtaaggatcggcgagtggcgcccaccatctctgcttgctgaaaagctgcagaggccgccaggagcccacgcacctgagacttttacctttacccagaaaggaataaaagaggtcagatgatgacagctgtgtccttaacaaccangccccaggaatcagtggcttttgaggacgtggctgtgtacttcactacgaggaatnggccatcatggtgcctgccgataggccttgtacanggatgtgatgctggaaaactatgaggctgtggcctttgtagtgccacccacttccaaaaccagc

SEQ ID NO: 18178 - DNA, 498 bp, Homo sapiens
acttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggtgagtactgtgcagccggaatcgtagttaacagctgttatttttcctttattcaggataatttcttctccactcagctacctgagagacttttttaaaaaacatctgtcatggttgggcgcgatggctcaagcctctaatcccagcactttgggaggcctggca

SEQ ID NO: 18179 - DNA, 353 bp, Homo sapiens
acttccgcccaggaagacgacgtagcagccatcttttccctggctttggtgattcagccctgacttctcaaaaagcactgcacagaggaggaggcagcagaaccccatttcagcttcttaggactctgcacttccccagaaggaagaattaaaaatgaatatgttcaaggaagcagtgacctttaaggacgtggctgtggccttcacggaggaggaattggggctgctgggccctgccaraggaagctgtaccgagatgtgatggtggagaactttaggaacctgctgtcagtggggcatcacccttcaaacaagatgtatcacctatagaaagaaatgagcagctttggata

SEQ ID NO: 18180 - DNA, 364 bp, Homo sapiens
aattagctgctgccgcgccttggagtccggagtaacttggccaggctggcccgagcggaactggagaaagctgagggggttgggcatgttccaggatctgtctatcgacttctctcaggaggaatgggagggcctggacactgctcagaaggacttatagagagatgtaatgatggagaactatagcagcctggtctcactaggtctctctatcccaaagcctgatgtgatttccttactggagcaagggaaagagtcctgcatggtttcaagggacgtaccaggaggatggtgcccagttttcctttaatgcagccatttcatgcatcaatggatattcattcagcactcttttttttttttt

SEQ ID NO: 18181 - DNA, 494 bp, Homo sapiens
aaatcgtgggtttcctgtggggctagggctcgccctgcgcccaggtgtaagtggaagttaattaaatgggcgtacgctgagtggtttgtttccagcctaggtccgcacgggacgtgatttatttagtgaaggggcacaagatctggagatctggcttgtacttttttcctttggccaggaactacgggcttaatctcttcctttggtctcctcatatgtaaaatgaggtggctgaggccgggcgcggtggctcacgcctgcaatcccagcacattgggaggccgaggcgggcaaatcacttgaggccaggagttcgagaccaggctggccaacatggtgaaacccgtctccactaaaaatacaataaattggcctggcgcggtggctcacacctgttgtcccaaagtgctgggattccaggtgtgagccacagcgcctggcgattaatatgtttcttacaatttagtaaatgattacaagctgcatttattcaa

SEQ ID NO: 18182 - DNA, 363 bp, Homo sapiens
acgggggccgagcccgagctacattcctcctcctccttcttcgccacccaaagactcacgcatacacacatttttctttcgtatctgctgtctcagcctcccacgggccaatttgggtaaatgcgtccaagaggaagaaataaaaatgaaaagactgacagtttaaaagcatgtggagggcttagaagataaagacgagtgcaagaaagggagagcgcggccggccgcggttgtctcacgcctgtcatcctagcactttgggaggccgaagagatcggatcacttgaggtccggagttcaaatccagcctggccaacatggtgaaacccgtctctactaaaaatacaaaaaaaaaaaaaaaaa

SEQ ID NO: 18183 - DNA, 333 bp, Homo sapiens
acgggggccgagccgagctacattcctcctcctccttcttcgccacccaaagactcacgcatacacacatttttctttcgtatctgctgtctcagcctcccacgggccaatttgggtaaatgcgtccaagaggaagaaataaaaatgaaaagactgacagtttaaaagcatgtggagggcttagaagataaagacgagtgcaagaaagggagagcgcggccggccggggtgtctcacgcctgtcatcctagcactttgggaggccgaagagatcggatcacttgaggtccggagttcaaatccagcctggccaacatggtgaaacccgtctct

SEQ ID NO: 18184 - DNA, 196 bp, Homo sapiens
acccttcttrcatttccatcccttccaccacagcatttctcccctctggaggatctascaactaattaccatcttggaagtagagcattcctcacaagttcataaaaatcctgctggtaccttgatttcggacttcccagcctctggaaccatgaaatataaatttctgttctttataaactaaaaaaaaaaaaaa

SEQ ID NO: 18185 - DNA, 203 bp, Homo sapiens
acccttcttgcatttccatccctdccaccacagcatttctcccctctggaggatctagcaactaattaccatcttggaagtagagcattcctcacaagttcataaaaatcctgctggtaccttgatttcggacttcccagcctctggaaccatgaaatataaatttctgttctttataaactaaaaaaaaaaaaaawtbcraa

SEQ ID NO: 18186 - DNA, 189 bp, Homo sapiens
ctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctaaaaaaaaaaaaaa

SEQ ID NO: 18187 - DNA, 366 bp, Homo sapiens
  misc_feature 175: n=a, g, c or t
aacggattagcaccttaacggattagcaccttaacggattagcgtggcaagaccaagagcagtgatgaccttttagctggaatggccagaggggtaacggtgactaatggtgttaaagggaaggaaagctcctgcccatctgcagcaccttcggcatctgsccctgscsatgacnactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagc

SEQ ID NO: 18188 - DNA, 367 bp, Homo sapiens
  misc_feature 144: n=a, g, c or t
accttaacggattagcgtggcaaggtttacagatctgggactgaaacccgcacaaggataaatggctgcctcaaggctatcttcaggcccattctgaaagaaaaaggaagttctcgtcgcagaaagaaaataataccaaagggnaacaaaatttcaagaaggaataaagaacagtggaagagtaaatatgaagaccaagagcagtgatgaccttttagctggaatggccagaggggtaacggtgactaatggtgttaaagggaaggaaagctcctgcccatctgcagcaccttcggcatctgcccctgccatgaccactrtggagaacaaatccaatattagcacaggtatggggtgacattcagtc

SEQ ID NO: 18189 - DNA, 249 bp, Homo sapiens
  misc_feature 142: n=a, g, c or t
ctggtgcggccgcggccgggaagggactggattatgtcggccccgtttgaggagcggagtggggtggtaccgtgcgggaccccgtggggccagtggtaccagaccttggaggaggtgttcattgaagttcaggtgccgccanatcgtckcccaggatatccagtgsggcctccagagccggcatggtggcgctgtcggtgggcgtcskcgagatcctcaagggcaaactctttrgattctacaatagct

SEQ ID NO: 18190 - DNA, 492 bp, Homo sapiens
aaatcgtgggtttcctgtggggctagggctcgccctgcgcccaggtgtaagtggaagttaattaaatgggcgtacgctgagtggtttgtttccagcctaggtccgcacgggacgtgatttatttagtgaaggggcacaagatctggagatctggcttgtacttttttcctttggccaggaactacggcttaatctcttcctttggtctcctcatatgtaaaatgaggtggctgaggccgggcgcggtggctcacgcctgcaatcccagcacattgggaggccgaggcgggcaaatcacttgaggccaggagttcgagaccaggctggccaacatggtgaaacccgtctccactaaaaatacaataaattggcctggcgcggtggctcacacctgttgtcccagcactttgggaggccgagcattcttcaggtaatctgaaccttctgagaaaacatggtcaacgtcttgaaaaggagtgcttatagaatgtg

SEQ ID NO: 18191 - DNA, 493 bp, Homo sapiens
agagcttctcatgcagcctgcaccagcgccgggtcggagagtcagaggccaccctgagatggaccgagatcttcagttggggaggcgcctccggcttggtggcatgcatgtttagtcccagctacacagcagggaggctgaggctgaaggaatacttgagcccaggaattcaagactagcctgcacaacataggcctcctctgtcacctgggctggagtgcgatggtgtcatcttgggtcactgcagcttctgcctcttgggttcaggtgattctcatgcctcagcttcccgggtggctgggattgcaggcatgcgccaccaggcccagcaaagttttgtatttgtagtggagatggggtttcactgtgttggccaggttgttctcagactcctcacctcaggtgatcacctgcctctgcctcccaaagtgctgggattaaaggaatgagccactgggtcgggcaaacacagagataaattgaaagcatattt

SEQ ID NO: 18192 - DNA, 296 bp, Homo sapiens
  misc_feature 288: n=a, g, c or t
aatgggccagagckkgtcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgscggggaaacgccgccacsggctgcatgggcagcgctcgcgccccgccgntgagccgs

SEQ ID NO: 18193 - DNA, 495 bp, Homo sapiens
attaaaagtagcacttagggctggaaagactttctgcaatgtttctgtgcagtctgtgaggatttaaagtagtttttcattcttagattttcttcaatttgacccgctgttgcaaactcccctgggaccacatggagggcccttccattcagtgctttacggtaatggtttcagagtttggtgttagcttttgctttgctgaaacttttcacagctgacttgataccagcactgaggcctgacctctcgatccttcagcacttcagaggttaattttgttgggggatcggatttctttcctggcctggggaatggtgatccctgctagctagtcctttagttacagagttgctgggtgcctgggattccctggcccagtgtgggctggctcagctggctaaaggacttgccatcctgtgagattcattcagcttctttgtccgctgttctccaagggccgcaatgtagtgaaatgctctggcctaggaaccttac

SEQ ID NO: 18194 - DNA, 420 bp, Homo sapiens
  misc_feature 19..20,272: n=a, g, c or t
cactcgstgsytcggcasnnctgctcttctaagatggctgccgctaccggtgcggtggcagcctcggccgcctcgggtcaggcggtaaggtaaaaagatcaccgatctgcgggtcatcgatctgaagtccgagctgaatcggcggaacttagacatcaccggagtcaagamcgtgctcatctcccgactcaagcaggctattgaagaggaaggaggcgatccagataatattgaattaactgtttcaactgatactccaaacaagaaaccanctaaaggcaaaggtaaaaaacatgaagcagatgarttgagtggagatgcttctgtggaagatgatgcttttatcaaggactgtgaattggagaatcaagaggcacatgagcaagatggaaatgatgaactaaaggactctgaagaatt

SEQ ID NO: 18195 - DNA, 266 bp, Homo sapiens
atgaaaagtagtagcatttccagagtataaatgacctttttttaatcatctcatttaattttctctcaagatttcacttagtattaacatcatggttagtagtgtttttaagtaagaattaaaatttgggggtgggtgcagtggcttacactgtagtcccagcacttcggaaggccgagtggggcggatcacttggtgctcaggagtttgagaccagccttggcaacatgatgaaaccccgtctctacaaaaaaaaaaaaaaaagg

SEQ ID NO: 18196 - DNA, 537 bp, Homo sapiens
acgctgaaaaaggatctgagggaaagtgggagattgatgaaccacttgtgccaaaggtaaagaagtgtgtggtcattcaccactaggtcaagcacaacttggcctaacctgtccatctcatggtgtctgaaacgagttgctgtatttctcattggagaattttaacacatagaggaagtttgctattggctcacatgtagaaatcttgttactatgtgtttttcttaccgcccagtgcttcttaccatgaccattttcttcccatttttcaaaatacaattccgtcacgtatgcttggcaattttggtctctgagaattgattttcactatgcgcagatgtctctgcttgagaaaaaatatacagctcaaaatctagcatatttgaaaagttatctagaatctgcagaggtccacacactggaagaggactctaaatgaatacataagaagtagaagatgcaaacctggagatatactgagtaactaactgttttggccaattttcccatgagatatgtttatcaggatatacacgt

SEQ ID NO: 18197 - DNA, 437 bp, Homo sapiens
aggatctgagggaaagtgggagattgatgaaccacttgtgccaaaggtaaagaagtgtgtggtcattcaccactaggtcaagcacaacttggcctaacctgtccatctcatggtgtctgaaacgagttgctgtatttctcattggagaattttaacacatagaggaagtttgctattggctcacatgtagaaatcttgttactatgtgtttttcttatcacccagtgcttcttaccatgaccattttcttcccatttttcaaaatacaagtaagtctcagctatctacattaatcaatgttaggtaakaatgtcctctacttagcagtcctcaaagcagcctttgttagcttcttcttaaaatttcacaaagacagaaatgaaaagtcacaataccactaccaacagattgtggaaagaatattaatcaagtatagg

SEQ ID NO: 18198 - DNA, 436 bp, Homo sapiens
aaaaaaaacgcatgcgcgtcgggcacagcgcgtgcagcctcgtgcagctcttctggtctccggsgcccgcccctsarrmgkkadkgtkrrwttaargarartmctttrtcagaagaagatggccactgcccagttgcagaggactcccatgagtgcactggtatttcccaataagatatcaactgaacaccagtctttbgtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagraaaaatatgtatacacaaacccagaagatcctcagacaatttcagaa

SEQ ID NO: 18199 - DNA, 517 bp, Homo sapiens
aaaaccttcctacttttcaggtaacaaaatggcagcttaggctagaaagccgctcatattcgcaggtacaagggctgggtaagaacgccccgcctggctgactaacttgagttccgcgctctggacaggaattatgcacagggcgtcgctgtggcactagaaaccccaaagtcacaagcgccccagatccgaccaggatgccgctaccggctacagcccagaggcccgctcctgcgcgcaagccgccttcctgaagaaaaagcccagtcccggcagcgttcttctccggctccgccttcttccgctcgactttctttgccattggctgacaacggagtacataaggacgtcatttcctgccgcctgtcttttccgtgctacctgcagaggggtccatacggcgttgttctggattcccgtcgtaacttaaagggaaaytttcacaatgtccggagcccttgatgtcctgcaaatgaaggaggaggatgtccttaagttccttgcagcaggaacccaa

SEQ ID NO: 18200 - DNA, 300 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaacacagattctcctctgtgctgtgtggacattgccatcccatgcaacaacaagggagctcactcagtgggtttgatgtgg

SEQ ID NO: 18201 - DNA, 250 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactggaacccagggctgascaccagcctctcacggaggcatcttatgttarcctacctaccaktgctctgtgtaacacagattckcctctgtgctgtgtgga

SEQ ID NO: 18202 - DNA, 247 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaacacagattctcctctgtgctgtgtg

SEQ ID NO: 18203 - DNA, 207 bp, Homo sapiens
atatatatcctcctggaatactggccagatggcatgctgaagtttgctgctgccactggagccactccaattgctgascgctttactcctggaaccttcactaactagatccaggcagccttcccggagccaccgcttcttgtgcttactgaacccarggctgaccaccagcctctcacggaggcatyttawgttaacctacctacc

SEQ ID NO: 18204 - DNA, 345 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtacacagattctcctctgtgctgtgtggacattgccatcccatgcaacaacaagggagctcactcagtgggtttgatgtggtagatgccggctcgggaagttttgcgcatsgtgacaccatttccc

SEQ ID NO: 18205 - DNA, 336 bp, Homo sapiens
  misc_feature 212: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttctygtgcttactgaacccagggctgaccaccagcctctcacggaggcatcttatgttaacctacctaccattgntctgtgtamacagattctcstctgtgctgtgtggacattsccatcccaygcaacaacaagggagctcactcagtgggttygatgtggtagatgccggctcgggaagttttgcgcatgcgtgaca

SEQ ID NO: 18206 - DNA, 512 bp, Homo sapiens
  misc_feature 401,414,429,504: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgcaacaacaagggagctcactcagtgggtttgatgtggtagatgccggctcgggaagttttgcgcatscgtgacaccatttcccatgaacacccctgggaggtcatgcctcagctctgcttctacagagatcctgaaganattgaaaaataanagcaggctgctgctnaaaatgcattgaccaatgaggaatttcagggtgaatggactgctccagctcctgagttcactgctactcagcctnaggttaca

SEQ ID NO: 18207 - DNA, 339 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtasacagattctcctctgtgctgtgtggacattgccatcccatgcaacaacaagggagctcactcagtgggtttgatgtggtagatgccggctcgggaagtttwgcgcatsgtgacaccat

SEQ ID NO: 18208 - DNA, 428 bp, Homo sapiens
  misc_feature 405: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtamacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattnaaaaagaagagcaggctgctgct

SEQ ID NO: 18209 - DNA, 418 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgchacaacaagtggagctcactcagtgggtttgatgtggtagatgccggctcgggamgttttgcgcatgcgtgacaccatttcccatgaacacccctgggaggtcatgcctcagctctgybbctacagagatcctgaagagatgaaaaagaagagca

SEQ ID NO: 18210 - DNA, 487 bp, Homo sapiens
taaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtgcattctgatgagcactgacaaa

SEQ ID NO: 18211 - DNA, 298 bp, Homo sapiens
atatatatcctcctggaatactggccagagggccatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgtttaacctacctacccatttgctctgtgtaacacagattctcctckgkggctgtgtggacattgccatcccatgcaacaacaagggagctcactcagtgggttt

SEQ ID NO: 18212 - DNA, 442 bp, Homo sapiens
tatccaggcatggtggcgggcgcctgtaatcccagctactcgggaggctgaggctggagaatcgcttgaacccgggaggtggaggtttcggtgggctgagatcgtgccactgtgctccagcctgggcaacaagagtgagactctgtcttaaaaaaaaaaaacaagaaactgtttacaaatctaaaaattattcctctccaacccctgatgtagaagacagtaggtcgagaaaacaatatctttattgtattaataatgtcaattttccctttcttaaacttttacctactgtagttatattcaaatatgaaaattcagctagtttttttttyctttttttggaagagatgggggtctcactgtgttgcctaggctggtcttgaactcctgggctcaagmaatcctcttcgacctcccgaagtgctgggattataggcatggg

SEQ ID NO: 18213 - DNA, 263 bp, Homo sapiens
  misc_feature 220: n=a, g, c or t
atatatatcctcctggaatactggscaragggcatgstgaagtttgctgctgccactggagccactccaattgctgacsgctttactcctggwaccttcactaactagatccaggcagccttcccggagscascgcttcttgtgcttactgaacccatggctgaccamcagsctctsacggaggcatcttatsttaacctasctaccattgctctgtgtnacacagattctcctctgtgctgtgtggacattgccatcccatg

SEQ ID NO: 18214 - DNA, 419 bp, Homo sapiens
  misc_feature 401: n=a, g, c or t
atatatatcstcctggaatactggccagagggcatgctgaagtttgctgctgscactggagscactccaattgctgaccgctttactcctggaaccttcactaactagatcsaggcagscttcscggagmcaccgcttcttgtgcttactgaacccagggctgaccaccagcctctcacggaggsatcttatgttaasctacctaccattgctctgtgtamacagattctcctstgtgstgtgtggacattgccatcscatgcaasaacaagggakctcastcagtgggtttgatgtggtagatgccggctcgkgaakttttgcgcatsgtgcacaccattwcccatgawcacccctgggargtcatgcctcagctctgcttctacagagatcctgaaganattgaaraaagaagagca

SEQ ID NO: 18215 - DNA, 448 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattgaaaaagaagagcaggctgctgctgaaaaggcagtgaccaagga

SEQ ID NO: 18216 - DNA, 219 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgmtctgtgt

SEQ ID NO: 18217 - DNA, 365 bp, Homo sapiens
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtasacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtc

SEQ ID NO: 18218 - DNA, 555 bp, Homo sapiens
  misc_feature 500: n=a, g, c or t
aaatttttcatattaagaaaagactagaacttggccaggtgtggtggctcacacctgtaatcccagcactttgggaggctgaggtgggtgaatcacctgaggtctggagtttgagaccagctgaccaacatggtgaaacaccatctctactaaaaatacaaaaattaggcaggcrwggtcatgggcacctgtaatcccagctactcgggaggctgaggcaggagaatcacttgaacccgggaggtggaggttgcagtgagccgagactgcaccattgcactccagcctgggtgaaagagcaagactccatctcaaaaaaaaaaaaccagtwttaatatgttaattttttycttaaacaataactggatcttttactctacaattagttttagagtctaccattttctacttagcaaaatattgkggattttttttcatgtcaataagcatccatctacaatakccatttwactgtccaaattgcatgggtatrgtatvcngagatttaaccaatcccctactgttaggcatttttcactgtcatagcagtttata

SEQ ID NO: 18219 - DNA, 466 bp, Homo sapiens
tagaaatcattaaggaaaattgacttggggaaaagtatatttctcagactgtcttgacattagtgacttttgattgtggaaaaactattgaacacaagatggcagtataccgttaactctgaaaacaagacaaggaatggatttttgactctagtaaagattaacatcaggccgcgcacagtggctcatgcctgtaatcccagcattttgggaggccaaggcaggacgatcacctgagctcacgagtttgagatcagcctgaccaacatggagaaaccccatctctactaaaaatacgagttagccgggcgtggtggcgcatgactgtaatcccagctacttgggaggctgaggcaggagaatcgcttgaacccgggaggcagaggttgtggtgagccaagatggcaccactgcactccagcctgggcaacaagaggaaaactccatctcaaaaaaaaaaaaaaaa

SEQ ID NO: 18220 - DNA, 172 bp, Homo sapiens
agcgcccggctttgaacccgccctgcactgctgtctgggcgggtccggggactcagcactcgacccaaaggtgcaggcgcgcgagcacaacccatggctgcgctgggctgcgcgaggctgaggygggcgctgcgaggggccggccgtggcctctgcccccacggggccagag

SEQ ID NO: 18221 - DNA, 254 bp, Homo sapiens
aaagaggactccaagcgccatggccgctgccgcccgagcccgggtcgcgtacttgctgaggcaactgcaacgcgcagatggctgtttcaaatattagatatggagcagcagttacaaaggaagtaggaatggacctaaaaaacatgggtgctaaaaatgtgtgcttgatgacagasaagaacctctccaagctccctcctgtgcaagtagctatggattccctagtgaagaatggsatcccctttacggtttay

SEQ ID NO: 18222 - DNA, 430 bp, Homo sapiens
agaagtcagaaagaatgagacataaaatacttgaagatgtaatggttgaaatgtttctaaatttgatataataaaacatcttccacaaaaatattcctgacaatcttattcataacatcagtccataaacaccttaaatgtccattaataggagaataaacatttttttcaatacaaactgtgttaatgaaagaaaaaagaagtgagtcttaagtcttcagttattttttcttcccacagatgagtataagtaacactgcaccttaatacctatggaatgatgcagctgaggtcagctggaggtaacaaggccagttcctggagactctgattaggtgagttctagagagatgagcatttgggaggacagatgggctgagccgatacaatgaaatactactcagcaaaaataaacaaattaatttaaaaa

SEQ ID NO: 18223 - DNA, 505 bp, Homo sapiens
acttttctgggtagatcccaggcagatatggcctctgatatgcttggcctttgagaccatgctctttcctgttctcctgaagaaccagtagctatgagcacaggggcctctgtcaggccagccaccagctatcgtgagaggagccaagttcctcattgccctgtgctgaaccgaactgcagcaagttggatagaggaggcagttttggcttgaacgcaaacatcctgtcggagaacagagtgattatagttttagctgcacacggggaaataacagcacagaggtgaatcatggcatctgtttactgctaattaacccctccgtgtacaccagtgttgtatgtgagccggcctgcggtctgaaccgcctcctataaggagggctcccttggcagccaaaaccagttggcccaaatgccttgataggcttcctgcttcacttgttgcccatgtggtctgattttagataaaagcattgcttttgggcctaaaaaaaaaaaaaaatg

SEQ ID NO: 18224 - DNA, 343 bp, Homo sapiens
atattccactgcctagaagcaagtcgcaggtcctgcccacactcaatagcagaggatttcacaaaagtgtgaagagtggggttgggggccaatggggccatcttatatagcctgtctaccacactggctgacatttctcactccttcagcacagtcctctactattggcacatcaaaaaggatgcacctgcttttcaacccaaaagatctgtggcattaaggcccccaccaacatggcagtataggttggccacctgctgaaaggcatctgcaaatccaatgtccttgtctttgaacaagactgaatataggcgtatacctgccttctgagatacacataagc

SEQ ID NO: 18225 - DNA, 306 bp, Homo sapiens
aggagaagggcgksgggggtacgagasgagaaaaaaaaagtgaaaaaamgaaacgaaaaggacagacgaagagtttaaagagaaaagggaaaaaagaaagaaaaagtaagcagggctggcttcgccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaa

SEQ ID NO: 18226 - DNA, 538 bp, Homo sapiens
gaaaggatgtacagaggatccccaaccgcctgcgaaacccaagccgccgcgtaggagcgtgcgttcgggccctcttctcccacctgttcggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacggtgaagaaagacgatgaggaggaggacccgctggaccagctgctctcccgctctggctgtgctgcctcccactttgcagtgcaggagtgcatggcccagcaccaggactggcggcaatgcagccacaggtgcaggcgttcaaggattgcatgagtgaacagcaggcgaggcggcaagaggagctgcagaggaggcaagaacaagccggtgcccaccactgagaccccaaaccacctatcccagtagatggccctgcaagaccagcacccagcaagattatagaggaagaaatct

SEQ ID NO: 18227 - DNA, 641 bp, Homo sapiens
actttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttc

SEQ ID NO: 18228 - DNA, 409 bp, Homo sapiens
  misc_feature 55: n=a, g, c or t
aaggatgtacagaggatccccaaccgcctgcgaaacccaagcsgssgcgtaggancgtgcgttcgggccctcttctcccacctgttcgactccccatccccaggatgtcaacctcagtccctcaaggccatacctggacccaacggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgcaagacc

SEQ ID NO: 18229 - DNA, 461 bp, Homo sapiens
agaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggar

SEQ ID NO: 18230 - DNA, 437 bp, Homo sapiens
tctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatt

SEQ ID NO: 18231 - DNA, 395 bp, Homo sapiens
ctcgttaaaaccagttggttgggcaacttaaatttttagaggatcacagatgtaggcttgagcagttgtaatagatgatttctttttttttctttcttttttctttttttttgagatagagtctctctctgtcatccaggctggagtgcggtggcgcgatcttggcttactgcaacctctgcctcccaggttcaggcgtttctcctgtctctactaaaaatacaaaattagccaggcatggtggcacatgcctgtaatcccagcttctcgggaggctgaggcaggagaattgcttgaacctgggaggcagaggttgcagtgagctgagatcgtgccattgcactctagcctggcaatgagcgaaactccttcttaaaagaaaaaaagaaaagaaa

SEQ ID NO: 18232 - DNA, 71 bp, Homo sapiens
cttccctgttatctttgtgacccactgatagcagctggtggtcctggtgcggtgagattttgactcttttt

SEQ ID NO: 18233 - DNA, 436 bp, Homo sapiens
catctaagccaacagcaaatgaccactttgccaactaatagataggactccgtttctgcatgggatgctgatgaccttaacaagctaagcaacatacacagtgtatgcaacatggtgattattaaatgtccattggcatcagcctagcattggagtctgtgtattgttagatataaactttgtcagtcacctttattttcttttgtcttttatccttcagttaaaagacttaggttaaaagtctctacttttaggagaactactatggagtttcatcttttataggagagcttcacattgtcctttgataatttcctcctgttaacaaaatttatgatataatatactttacaaagtaatagtcttaatgttctaggcttttaattagttttagtagtttggatactatgaaataaataaggtataccggaactaa

SEQ ID NO: 18234 - DNA, 476 bp, Homo sapiens
catctaagccaacagcaaatgaccactttgccaactaatagataggactccgtttctgcatgggatgctgatgaccttaacaagctaagcaacatacacagtgtatgcaacatggtgattattaaatgtccattggcatcagcctagcattggagtctgtgtattgttagatataaactttgtcagtcacctttattttcttttgtcttttatccttcagttaaaagacttaggttaaaagtctctacttttaggagaactactatggagtttcatcttttataggagagcttcacattgtcctttgataatttcctcctgttaacaaaatttatgatataatatactttacaaagtaatagtcttaatgttctaggcttttaattagttttagtagtttggatactatgaaataaataaggtataccgaactaagtaataataatacaagtttcaaaaatcagtactacatagag

SEQ ID NO: 18235 - DNA, 418 bp, Homo sapiens
aaaattgctcaggttctctttaacggtgtgtaggctttgttttttcactgtgtgggataaatcttgctgttgttcagcatttggggccatactgcctttatgaactgtaacactcaccataaaggtctgcagctttgctcttgaagccagcaagaccacgaaacccccagaaggaacaaactcctgacgcatccaaacctcagaagaaacaaattctggacacaccatctttaagaacggtgaaactcaccgagagggtttgtggcttcattcttgaagtcagcgagaccaagaacccaccaattccggacacaatagtttttacccactgccagactgtcagcccccaccaggcaggacatttcattgctgctgaatctcagggtgtaggacagtacctggcacatagcaggcatac

SEQ ID NO: 18236 - DNA, 337 bp, Homo sapiens
tgaacgcacctcaggatggcccgtactttggaaccactagcaaagaagaggaaaagagcagagcgctttgggattgcctgatgaaaagttcctgatactttctgttctccagtgttttccatttctctccttcttcttggtcacatatatgsctaaaakgcacagtcatgtgcctacgtcctgcctcgcaatgagggagcatgtaccccaggtacatccatgaactgcggcasagtttgacttattgctgtttcagctttaaggttgttgtgtttttgtttttgattatgttgcttgttaataaaaaaaaaaaaaaaaaaaaaaaaaaaaaaaaaar

SEQ ID NO: 18237 - DNA, 661 bp, Homo sapiens
tatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacctatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgagagtatggaactgtctgcattggaccctaaactggactagaagaggcatcttcaaggttcatacgttgtccagctgtaagttcatttgagtagcagacctaacaaatatttgaggtcaaaaccctaccatgg

SEQ ID NO: 18238 - DNA, 457 bp, Homo sapiens
agtaaaatagaccatccataccttcttatcagcgtaggatatgcctcctatcatgctagcattctagttggaaccttgacactgaagtgccttctgcctccctccatgattctgaggcctccccagccatgtggaagtatgaaaaatcgttacactgggaaggctgcccatagaaaaccataactgaaggcattgcatgttgatcccaccaagagggccacactcacctcggaagtggttgagcctgtccaccggtcctgtgatgggccctgtagggagctctggattcacaggctggagcatgtgcagcagcacggactcactcctgcaaggaactctttaggtgcaagaaaatccgtctcatttgttcatttctgcattggcttagaatgtttattaagacacagtaggcacttgatattttgaagaaaaaagtattgaagtgggtgtggtcttc

SEQ ID NO: 18239 - DNA, 453 bp, Homo sapiens
cagtcttctgccactccttttcgtggtccttcccttcactgccttccttctcccagacagactgggcatccagttccaatccaaaggctgcccctttgaccaggcccatcttctccacctcacatcagacagccaatcggctgcccagacctcgaaacctcagtaacctagaaggaaatggaccttggcaaacgtgtgtcaggagaggatgacttggaggtgtccaccgtgtttcttactgaagatgtctaaaagtcaattggggtcaaggaacaagcctctactcacatgcatgtgggcaaatgaagtcacagaacaaataacctaccctgcatccaggcacggagtccagggacaccccctgctgctgcctaagagaaagtggcccaagaagcactggcccggtgcctgctgatgccaggagccctctgctactgcctgacacaagcatcc

SEQ ID NO: 18240 - DNA, 293 bp, Homo sapiens
cactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaraaaacaacaacaacaacaacaacaaaaaaaaacaaaa

SEQ ID NO: 18241 - DNA, 402 bp, Homo sapiens
  misc_feature 193,198: n=a, g, c or t
aagcaaaatctaggtgctgcaagaaaagtcacagccttggggtttcagtgaagagacagcccaaatctcttgaagtagtcagaaaagtctayaggtgtgactcccttatgccgctctctcctgccatttgggcaacagccaacttccgaggccaaccttgtttctggagaagcattcttcccacattggaaangcaangatggtgctgagcctgataacttataaatccttgcattcaagcctcatgctaagatgttgaaaaacatactcttatccccaatttacaaatgaagaaatggaagtcaagacttttcccaaggccaccaaactggttaagtggcaagtacttaaggctcccaagttcagcaatgtttctaatagactcagaaatgtaaaattaac

SEQ ID NO: 18242 - DNA, 413 bp, Homo sapiens
aagcaaaatctaggtgctgcaagaaaagtcacagccttggggtttcagtgaagagacagcccaaatctcttgaagtagtcagaaaagtctacaggtgtgactcccttatgccgctctctcctgccatttgggcaacagccaacttccgaggccaaccttgtttctggagaagcattcttcccacatggaaaggcaaggatggtgctgagcctgtctgcctctgtgttccctggacaactccattccagtgcaagattctcatggttgaattcatattttaagtgctgtttgtggggttttgagcagttgccattctgaggaggagcagaggagcatggctttgcaaagtgtctcccaattatgagcaccatctgcaagagtccacttggaaaatactcaaggaccagcaagtt

SEQ ID NO: 18243 - DNA, 396 bp, Homo sapiens
aaaaaatctaggtgctgcaagaaaagtcacagccttggggtttcagtgaagagacagcccaaatgctcttgaagtagtcagaaaagtctatagggctgtcggcttgccacatatgcagcccttaagcaaagtgggagcagttagtggtggcatcaagaggacagccacaggcagagccctcagccttttgctgttgactctccacaaccccctcttcttggaggcagatccttaaactgatgcctcaaaatatttttaaaagcgcaaccaaatatgaagacctttcctggctgccgggccttttctgtcctgttaattttgcttggctttaaaagagtgaagaatcaatgtctagcatttccaatgaccagtgtgactcccttatgccgctctctc

SEQ ID NO: 18244 - DNA, 509 bp, Homo sapiens
gagtgcgcccttctcgggtcccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcagaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaa

SEQ ID NO: 18245 - DNA, 418 bp, Homo sapiens
aaatttagaagctctgtatcagaaactagagtcaaaggcaaaatattagaacaaaagatactcctagcacacccatcacttgggaaattacaaaggttttagaagctctgggccaggaacccaggatgaagactcagtacaggttgagtatcccttatccaaaatgcttgagaccagaagtcttttggatttcagattgttttggattttggaatatttgcattatactggttgggctgccctaatccaaaaacatgaaacctgaaatcctccaatgagcatttcctttgagcatcatgttggtactaaaaaagtttcagattttggagcactttggattttgaattttcagattaaggatactcaacatctatgtatttcttgttatagctcatatcacagctataagtttaaaagc

SEQ ID NO: 18246 - DNA, 540 bp, Homo sapiens
actatcacttaggaaattacaaaggttttaggaggtctgtggcagaaactgggtgccagtctgatagcatcaatttctctcagtatttgtctgtctggaaaaggtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaagaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaatatgggaagaagatgtgggagacaaagatgtggagctgtcttc

SEQ ID NO: 18247 - DNA, 150 bp, Homo sapiens
actcggcggccgcggcgcgatggaggcgccggccgagctactggccgcgctgcctgcgctggccaccgcgctggcccttctgctcgcctggctactggtgcggcgtggggcggccgcgagcccggagcctggagagcccgcrgggctggg

SEQ ID NO: 18248 - DNA, 148 bp, Homo sapiens
atttattggataccggcttttcatggggccgagcgccgctgggtaggcggaagtagccgcacrtggggcggcggctatgsttgctctgctcgtcctgttgctccskggcccggcggctggtgccttgcagaacccccacgcgacacct

SEQ ID NO: 18249 - DNA, 383 bp, Homo sapiens
tatatattaattgacaaatattaaaaccatactaaagttagctatgtggaaggatggccaatagtttagtatcattgttacattaagaatcacaaatagctggcacggtggcttacgcctgtaatcccagcactttgggatgcctaggcgggcggatcacctgaggtcaggagttcgagaccggcctgaccagcatggagaaaccccgtttctactaaaaatataaaattagttgggtgtggtggcacatgcctgtaatcccagctactcaggaggctggggcagtagaatcccttgaacctgggaggcagaggttgcagtgagccgagatcacgccactgcactccagcctgggggacagggcaagactctgtcacgagaaa

SEQ ID NO: 18250 - DNA, 472 bp, Homo sapiens
ctgttttatgtgtgcttcccagtcctgtggtgctgctataccggggacgttgagtcccacagacctggaaattgcggcccctctttctcaacccagagcaaattgagacgtccgggtgagagtccgtgagtcccttcgagtttaaagtggccctgaggcaggtcccgtcctcggtctttctgcagtggggtcgtgcagacacctcctatcgcggaattttccttctcaaaacccttcctgacctgtcctcccgcctcgcgctgtttcaagtcctcacccgcgagctggattccagccctaggcgcctcccaccgtcgctctcggcggcttcaggagcgccgcgcctcaaccccggttcccgggaggccgcgtcctctgcctggtcctaagatcctgcagacgccacccctgtccgaagctccgtcgctccccacctccctccttgtgcggtgttgctacctagttccaactc

SEQ ID NO: 18251 - DNA, 581 bp, Homo sapiens
aataatttgttctagggctatggagatgctcataaaggattctcattcctattgtaagccagagagaatgcaatccaatgcaatgtttcgatcatggagtctttattggacacaggctggcatgagttgatggcacctgaaaatcagcaagctacaaatgctcctgggaggaacagcatcttcagtctctaaaccttggtgcagctgagtttattagaggttttccagaccttaacaagagcctgtgacagtactaagaccctggggatggtgcgaaggagtctggaaccaggaggctgctgcgttttacaggatactggagcccagttctcaatcaaacgctagagctcagaaagacatgcctctcagatctgtctacctttaagcatttttttaattaataactggatattgaccattaaaaccatcacaggtataggagtttgttgactaaaatttgtattatagatacaactgaaatgtttacaaatctttataagaaaatcattactacttgggtcagaagcatgcaagtcaagcttaggtctatggkttttgctctgatcagtaatatgtagatg

SEQ ID NO: 18252 - DNA, 414 bp, Homo sapiens
ataatttgttctagggctatggagatgctcataaaggattctcattcctattgtaagccagagagaatgcaatccaatgcaatgtttcgatcatggagtctttattggacacaggctggcatgagttgatggcacctgaaaatcagcaagctacaaatgctcctgggaggaacagcatcttcagtctctaaaccttggtgcagctgadtttattagaggttttccagaccttaacaagagcctgtgacagtactaagaccctggggatggtgcgaaggagtctggaaccaggaggctgctgcgttttacaggatactggagcccagttctcaatcaaacgctagagctcagaaagacatgcctctcagatctgtctacctttaagcatttttttaattaataactgggatattg

SEQ ID NO: 18253 - DNA, 429 bp, Homo sapiens
ctggtgcagggtttacctcggctccctcgggacgggttccgtgcagctcctgcttcctcccttctctttcccagtgccatccctggcgagggggaaaaaaaaaaacacggcmaggagayttcccacccctgctttgctatttttgtacctccgtgacagaaaaacaaaaccctgaggaaaagtcaggcgacttcattccctgccgtccgcgccggggcctcgactactgctggcgtccgcggctttcgcccgccgctccacaggcgagttttaagagatttctcacaattgtcaagtccgcaagtctccgtgcgtttgcttttatttgggccgtgcgttcaaatccgctcataattctttctgaccctcagaggggccctgaagtaggtgacaaatttgccttggatccaactgggtggttttatgatc

SEQ ID NO: 18254 - DNA, 513 bp, Homo sapiens
accaaatgaattgctattcaagtatctggtgcctggttgtacatgtttctaagggcaaatttcctaagccccctttcctcaaatatttcacttgtgcttattcagtaaatctaacaaaataaggatgcttttgagctattgattggtgcaaatgtggcttaatagcagaatcattacttttttaatcttggaactgccagctcttactattttcaactgaatttcgagtggtttgattacagcctgccattactaattgtttctaaatttcatggaacatatcttgtttaggaagttttcttcttttggcaatactttttcttttttttcttaaagtctcagttttcacaactttatctgctcagacttatgggcctctctttttagatgtcttaatcttgaagcaggaaaagtcagaacttgtttgctcactcagaaaaatgtggcctcgttgactcctgaataaaatataattttgggtcaccatccccatttgctcagtagcattaaagt

SEQ ID NO: 18255 - DNA, 407 bp, Homo sapiens
agtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctac

SEQ ID NO: 18256 - DNA, 153 bp, Homo sapiens
  misc_feature 46: n=a, g, c or t
aacctggactgckcccctgaccgcaacccctasscscgcccaccantatggcccggcacgtgttcctaacggggcccccaggttagagcctccacctggaaaacgtgaatccgagttgggcagtatgtggtcgacctgacttcttttgagcag

SEQ ID NO: 18257 - DNA, 438 bp, Homo sapiens
actagcgcggcggccgccggcccgcaatggtgctaccctggttgctgctcgagactgcgcgcagggcggtcctcgggtccgcggaggctgcgctctgccatgaaaatgacagatgaaaatagaaaagtgtggctggtctgaagtggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacagagataatagcggccaggcgtggtggctcacgcctgtagtcccagcactttgggaggccgaggcgggtggatcacgaggtcgggagatcgagaccgccctggccggcatggtgaaacctgtcactactgaagataca

SEQ ID NO: 18258 - DNA, 341 bp, Homo sapiens
actagcgcggcggccgcggcccgcaatggtgctaccctggttgctgctcgagactgcgcgcagggcggtcctcgggtccgcggaggctgcgctctgscatgaaaatgacagatgaaaatagaaaagtgtggctggtctgaagtggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacagttactatgagaggtgtgttaaaatctctctctgaaaaaaa

SEQ ID NO: 18259 - DNA, 496 bp, Homo sapiens
caggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaarattgcagatttttaatttaaaatacatttttat

SEQ ID NO: 18260 - DNA, 467 bp, Homo sapiens
catttatgggattttgtagcctttgggttctccattcttaatgtggttagagaagccctttcaaataaaaatttactaatttaaattttacagttaacctggtgttcacaactaacataatcctggggttactgctgactgtagcattaagacattggcaaataacataacctgtctttgtgcttgccttttatctataaaaccaggataatatgtccctacttcagagggatacaacctctgaatgtaacctctctccctacaataacattttttgattagagataaaagaatattaaacagaacttttagttcttcagaaggaaggtactatgtttataaaataatcagtgctcattttcatttagcctgaaggtggggtcgctttttaaaaaggattattaacctactaagaaaaattgtgtttcattttaaatgttagaaagcaacttttcagaaaaacttga

SEQ ID NO: 18261 - DNA, 577 bp, Homo sapiens
tttagaaagataaattaggtaatgtggctttgtgtatgcagtagagttaatatgcttttattcacctcatggtttctatgtcattaccacctgttggtttttattttttaatggaaaacttgaacttctccaaagtgactagttttaaaataacatttatgtaaggattgtttatacagagaaattgaaaaccagaaggtataaagacaattaaaattatctaaaattctactagttagaagtaactactattaatattttgttctatatccttccaatattttttcatatgtattttttttacatagttggaattgtgcatccatattattttgtaatatgttttattatttaatatattatgaaataaatgtttgtgatttaaaaaatcaatatagaatttcagtgtacaggtgtgctattatctgtttaccattctgtgttgaaggtcttttaggcagtttgcaattttgggatattgtaagttgatggacatccttatacattaaaaaaaaattatatggctgattatttcattacaataaattcctagaagtagaattacttaaaagatata

SEQ ID NO: 18262 - DNA, 430 bp, Homo sapiens
  misc_feature 23,28: n=a, g, c or t
accatccgggtactctaagtccncccdnccccttctccttcacccccaagtgtctccsacgastgccctccccgasstctagctgascatggcatcagaggsagaaaaaacattccatcggtttgctgcgtttggagaatcatcaaccagtggcactgaaatgaacaacaagaactkctccaagctgtgcaaagactgtggcatcatggatggcaagacagtcasctccacggacgtgagcatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggaggggcaaagacccagccaccactgggcgctactaaagcaacaacag

SEQ ID NO: 18263 - DNA, 445 bp, Homo sapiens
accatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactkggccagaagcgcttcaaagggaagagtccagatgaagtcctggagaacatttatggactcatggagggcaaagacccagccaccactggcgctactaaagcaacaacagtgggtgcagtggaccgc

SEQ ID NO: 18264 - DNA, 551 bp, Homo sapiens
aagaaaaaggatttgaaaagcaagttaaattttatgagtagatgttggttttaagtttaacatcttctctctagagaaccaacaacaattacaacaaagggtttttattcaagaagagaaatatatactactatggtacttggtttaaagtccaatttattaaattcctatatctgataaaagctttgaaaaccaatttttgttcagatgctgattatacatttcattaattaaattccctcaagtaattttaactgtagttacaaatttagtatggttgattcttctgaatatatcgagcatgttaaacagcaattcatgtacaaaaacaaatcaagattcccgatgtgaaaaagaagattcacagattcacatgtcatctgttccaagggagatcaacggttgaaacactatagaaatcagagattgttagggtcagtaggctgtactaggatggcctactgtagtatgctctcctcaaaaaaaaagattatgacaaaatgcactgtttttcaatgagaactgctgaaagtggggctaggtgagaagtt

SEQ ID NO: 18265 - DNA, 513 bp, Homo sapiens
gaaaaaggcaaatgatagtacacagtggggcattgggttcaaacctacacagttaggctctaggctctagccactgtgtagcttgacctgttgggatatcagagttaaaacttaagtattagaggatagaaaagtaagaggagaatttgaaaaagtatctaatattggaaaaatagggtaggacacctgggcagagggaacagacataaaaataagaataattgccatgtcctagataattagaggttagcaacccaataagatgaaacagtaggagactgaagaagctggaaactctatgagagaggtaaccagtaattcctatatgatagatggctaccactgaattaggttgactgtgcaaggcaaaccctagcataacaggcctcagctgtaatggataaggacaccttagcatctccaatcgataggaaagaaagggcatagcacccaggaaattattctccatcgtgactcaccaatgaggcaggggataggggagaggcaggggat

SEQ ID NO: 18266 - DNA, 546 bp, Homo sapiens
aaaagtcatctatgtttcctgataaaggggacaattatttgccatggcactaagatgtgtcatctttgtgaatatgatctagaagaaaaagcacaattatttaaatatggcccattttggtttctgatagatttgtttgacaccttttcttattttgaggtgtagtatgcttccatgtacctttccagtataaattcaggtcctaccatctggagtgactcaaagtaaggttggacttcttttggaagacaaaaacaaacaaacaaaaagcaaaaacaacaacaacaaaaacaattattcaaatatttgaagataaatattgctgcgaaaggccatcatggcatgttcatcatatggcatcccctgctatgtctcttcctggttgggaggaaatggggtccttcacctgctgcccaagacgggtgcgtgcaagtcatctcctgtgtcgactgtgggacgrgacccgctgatcataagaaactgaactgatactcactgttgaactgggctttctctgtttcttctatatgatagtaaagcattgtt

SEQ ID NO: 18267 - DNA, 476 bp, Homo sapiens
smacctgataagcctggcagaagcytgatgaacccagaatgagtgagatgtggtaagttgtgctttaggttagggcgtcatctaactgttgggccagaaaatttaaaggggagaagtgcatcctaaagggagttgcagtttcctcggttctggtaggactacaagtcccaatatgcaccgctcccccgggcgacctgagtgtctcttgagtaaatgtgacccttgaaacgtctacgttagcagcttaatggtttctccagccttgcgcgtgtttccaagtccctaaacgggatggtttttgaaaggctcgaacacttgacaagtaggaaagtggtattttcttagcctaagttatcttaacacgtgatttgaaatagtgctggtaataacaacacaccagccctgcattgagcgtttgttttggaaaagaacctaggaattccagaatgatcagagtcacagctacaaactgagat

SEQ ID NO: 18268 - DNA, 106 bp, Homo sapiens
agaacgccgtgcgtttgagcttgaacctgataagcctggcagaagcctgatgaacccagaatgagtgagatgtgtttctaaaaaaaaataagagagaaaggatggs

SEQ ID NO: 18269 - DNA, 403 bp, Homo sapiens
accaggaagggaggaagcggcagagggggcagcggctggggataccggccgggaggtcccctgtcgaaaagggaagccggtgtgctgggtgcttagggcatgttccgggacacgctcaggccagagccttgctggatgtgcccttggtgggacttgggatggaaacccagacgttttactcmscgmtctgagcacatcgctatccctccsccccctcaccaggctgctgaataacgagggatcactgctggcctactctggttacggggacactgacgcccgggtcaccgctgccatagccagtaacatctgggccgcctacgaccggaacggaaccaagcgtttaatgaagacaatctcarrttcatcctcatggactgcatggagggccgtgtagccatca

SEQ ID NO: 18270 - DNA, 270 bp, Homo sapiens
taatcccaacacagagaggctgaggaaggaggatctcttgagcctaggagttccaggccagcctaggcaacatagggagaagggagaccctgcctctattttaaaaaagaaaagaaaaggagtgtggcttagagagaggtgtcagatctgccagtctttgtgatcacctggggaaagggagaagtcactgawggtgttcaggtctctggtctctggatagctaggaggagaagggacagtaaagtccttgaaaaggaaawatgggggcca

SEQ ID NO: 18271 - DNA, 385 bp, Homo sapiens
  misc_feature 84: n=a, g, c or t
agacttaagatggcggcgtttgcacggagtgaatcactgcgtccttacgggggttgcaaggcgtccgaagtatgagtccactancaaaagtccagaaactcgccagttaatagtattgtgtctcttcaaaatatcggagaataatttctttctcgctgatcgcctaacttctactgacgaagcttggaagttgcagaaggttggagtgcaatggcgcgatctcagctgactgcaacctccacctcctggattcaagctattctcctgcctcagccagccgagtagctgggattacaggcatgtgccaccgcacccagctaattttgtattttttagtagagatggggtttctccatgttggtcaggctggtcttgaactcctgac

SEQ ID NO: 18272 - DNA, 318 bp, Homo sapiens
gacttaagatggcggcgtttgcacggasrdttccactgcgtccttacgggggttgcaaggcgtccgaagtatgagtccactaacaaaagtccagaaactcgccagttaatagtattgtgtctcttcaaaatatcggagaataatttctttctcgcgtgatcgcctaacttctactgacgaagcttggaagttgcagaaggtagctcctaggagggatatatgggtcgtttctttcctttttccttatttaaatgggtttttattgacaccatgtcgcgccaaaatggattccatctcctcagagctttcctaggaaca

SEQ ID NO: 18273 - DNA, 387 bp, Homo sapiens
ttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacattttwaaatgtgattayctaatttttacaacactgggctattaggaataactttttaaaaatwactgtsctgtataaatatttgaaatycaagtacagaaaatatctgaaacaaaargcattgttgtttggcmatgatacaagtgcactgtggcagtgccgcttgctcaggacccagccctg

SEQ ID NO: 18274 - DNA, 169 bp, Homo sapiens
ggcgacgactgcagctcgggaggtagcggcctggcgagggacgggccgtctgccctctcggacggccgcggcggagggcaaaaatggcggaggcttcggcggccggggcggactcgggcttcatcctgcacaataaactccggaagcaagtaaaaaaaaaaaaaaaaaa

SEQ ID NO: 18275 - DNA, 592 bp, Homo sapiens
atttaaaaaacatttttagtgttatgaatgtgtacttgaggaactcttatacaatccattatattgaaaaggaaatacaacattatatttaagattatacttaagatatgatgactctaaagtggccaaagtcccctttgtcaggaacactgaataatttcagcctgcatcagactttttacatgcttttaatttgaaagtatttataatattctgaaaaaaccatcagccactaagacattgagaaatgtcgagtttttctggattttattccataccttgatatgagccatgaatgaataagacaaatgactatactttttactttacaagaaaacaaatctgaacgttttagcccttgatttttacagaccamacccaaaaacctcaaaaaaggctctatgagctgctaaatacatttttggagattcactattctgtttagaaacaaattccacagccaccccaaactttcagcaaccgccaccctgatcagtcagcagccatcaacatccaggcaagaccctctactaacaaaaaaacattacaacttgcagaaggctcagatgattcttagcattttttagcaata

SEQ ID NO: 18276 - DNA, 453 bp, Homo sapiens
  misc_feature 174: n=a, g, c or t
atttaaaaaacatttttagtgttatgaatgtgtacttgaggaactcttatacaatccattatattgaaaaggaaatacaacattatatttaagattatacttaagatatgatgactctaaagtggccaaagtcccctttgtcaggaacactgaataatttcagcctgcatcagnctttttacatgcttttaatttgaaagtatttataatattctgaaaaaaccatcagccactaagacattgagaaatgtcgagtttttctggattttattccataccttgatatgagccatgaatgaataagacaaatgactatactttttactttacaagaaaacaaatctgaacgttttagcccttgatttttacagaccacacccaaaaacctcaaaaaaggctctatgagctgctaaatacatttttggagattcactattctgtttagaacaaatt

SEQ ID NO: 18277 - DNA, 204 bp, Homo sapiens
tattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtcaaaaaaaaaaaaaaaaa

SEQ ID NO: 18278 - DNA, 371 bp, Homo sapiens
gcttttctacgtggttcggtactgctggctacgcaggcaggcggccctgcagaggaggctcagatggagtctcattctgtcacccaggctggagtgcagtggtgcgatcccggctcactacaacctccgcctccctggttcaagcgattctcctgcgtcasgtcccgagtatctgggactacaggctggagtccaatggcgctatctcagctcaccgcaacctccacctcccaggttcaagcaattctcctgccccagcctcccgagtagctgggattacagtgctcaatggtgccccggctggagtgcagtggcatgatctccgcttgggcgacagaactagactctgtcccaaaaaaaaaaaaaaaaag

SEQ ID NO: 18279 - DNA, 365 bp, Homo sapiens
  misc_feature 11: n=a, g, c or t
agcgggacggnagattggagaccagcagcagggagctccaagccgcggagtatttggaaaagcatcagatcaaggaggtggttagctacctcaccagcgccctccttttctttcggccgggtctaggaagtatttttcttatttttcctttacctatatcttttctggaaattattattggatattggacatcttggcttgattttctaatttactttacatcttgatatgttgtataatttttatcagaagaatgcaatttatgaatctgcagattctcttgagaatttaccaaattgttattttgatgctcctcactgacttatacttacatttcctgtcttcattagtcgttctttatggaa

SEQ ID NO: 18280 - DNA, 397 bp, Homo sapiens
ctatttagagcacgtttccctgagtagcctcatggcttgttcccgcatcaccttgagatttttgatcagatgttacttttgggcctgttatggtggctcacacctataatcccagcgctttgggaggccgaatggggaggatcacttgaagccaggagttcaaggctagtcgggcatcatggtgagatgctgtctctgtgaaacagcaacaacaacaacaacaacaacaaattagccaggcatgatggcatgtgcttgtggtaccagctacacaggaggctgagtggggaggatcagttgagcccaagaatttgaggtggcagtgagctatgactgtgccactgcactccagcctgggtgacagagcaagaccatgtctctcaamaaaaaaaaaaaa

SEQ ID NO: 18281 - DNA, 327 bp, Homo sapiens
atttacttcctgcgggtgcacaggctgtggtcgtctatctccctgttgttctycccatcggcgaagatggccctggagacggtgccgaagacctscggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatgggtaactttaagccaggtgtatatgcggtgtcagtcactggtcgcctgccccaaggaatcgtgcgggactgaaaagtcgaggagtgg

SEQ ID NO: 18282 - DNA, 438 bp, Homo sapiens
gtattagtccgttcttgcattactataaagaactacctgagactgggtaatttataaagaaaacaggtttcaatgactcacagttccataggctgtacaggaaacatgtctgggaaggcctctggaaacttatgattatggcagaaggcaaaaaggaagcaggcacatcttcacatggcagagcaggagagagagcaaaggtggaagtgctacacacttttaaacaaccagatcttgtgagaactcactcactatcatgagaacagcaagggcaaagtctgctgccataattcaatctcctcccaccaggcccctcctccaacattgaggattatcattccacaggagatttggatggggacacggaaccaaaccatatcgactcctgaatctaaaataaaagttgaaattatagaaaagaaaaaaataaaaaactta

SEQ ID NO: 18283 - DNA, 559 bp, Homo sapiens
tttctgaaacccaatctggggacagtgcagactaaataaaatttcattttgatttggcctcccgctgcgaatgggactgctttgtctcagccgacagaaccagcaagccagaaagggaatgaagacatttggagaagaagcgtttactgaaaggagattcctgggctggaggaaaaccatgatctacagttcatgttgacagatattgtatttttggtcctagatctgacttttgaaatgacttatcacaaattcaaatttagcaatcatgagtgaagtacccacgatgtgctaagcatctacctctgcagatagaagaacacttactgttcctgagcatgggagggaatagaagttcctgggtcctggcctcacctcatcaggcactgccaaatttgacacctccttcctgttcacggcagtcctttgcgatagggtattagatgccaccaagtagctgcataactcacccatttggtcagagcctgggtctaagccaggtctgacagactccaaagcaagccctgtttamaggcatgactgggatccagtggacgag

SEQ ID NO: 18284 - DNA, 363 bp, Homo sapiens
catgttggggcatactcattaggattgagtgctttcttacaccaaaatacatgtatacaaagatttaaaacactttcggccgggcgcgttaatcccagcactttgggaggccgaggcgggtggatcacaaggctaggagatcaagaccatctggctaacacggtgaaacctgtcgctactaaaaaaatacaaaaaattagccggacgtggtggcgggcgcctgtggtcccagctactcgggaggctgagacaggagaatggcatggacccgggaggcggasttgcagtgagccgagatcaccccactgcactccagcctgggcgacagagtgaaggctatgtcccaaaaaaaaaaaaaaaaag

SEQ ID NO: 18285 - DNA, 446 bp, Homo sapiens
aacagcgaggcgccggcccagactccactccccagctgtgaaaggaggagctctacggtgacttctgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtaacagcatacaggtttcccccccccaccccgtcatgtacagctgaatcatgcagaatttgaagatcaagatgatgaagccagagttcagtatgagggttttcgacctgggatgtacgtstgcgttgagattgaaaatgttccctgtgaattt

SEQ ID NO: 18286 - DNA, 355 bp, Homo sapiens
aagaggcgcacaggagacctcaggcccagactccactccccagctgtgaaaggactgctggccagacccccaagctagcccgccagcctccatagagctgcccagcatggctgcatccagtaccaagagttggtgggagacgggtgaggtataggctcagtctgcggccaagactccgtcctgcaagtaaggtcccctccaggggcaaggctgggctgcagagccagcactggggagtttagtagcaggccaggtttccttgttaagacaagcgtgggactgtccaggatgaatgtgggcagacagaaccctgaggtattgcagtagggttgggttcacccttgctggttgtaga

SEQ ID NO: 18287 - DNA, 458 bp, Homo sapiens
tttttcgacgctggcggtggacgcaggcagcatggaccacggttgctgggcggatggggagcgtctatggtcagttcctagaactttcctgcttcaggacccgaagtgcacattcaagaatgcaggaggagtgatctcctgctgtgggcacagttgccttagaagtggtgagatgggaagctgcagttggaagaccctggaggatgcctgacaaggggatgtctgacacatgattggagctctttttgaaatgtttcttgcccttcctggagcagaggagccattatttatgcaggtacatcgaagtcttttgacctccatacagtgattatgcttgtcatcgctggtggtatcctggcggccttgctcctgctgatagttgtcgtgctctgtctttacttcaaaatacacaacgcgctaaaagctgcaaaggaacctgaagctgtggctgtaaaaaa

SEQ ID NO: 18288 - DNA, 433 bp, Homo sapiens
tttattaagttccctctgtatgcagaatattgtgcaacatggttatgggtactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagggcaagtagagctgcagctgtctggcgccactgtaatgctgtctcctcctctgagtgagttcatcctggaaacattttctcccataagacatgcacaggtcttacgtttacatgtttcactgaaagaaatttgattccactgctggg

SEQ ID NO: 18289 - DNA, 418 bp, Homo sapiens
aagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagyaaaaaaaaaaaaaaaaaa

SEQ ID NO: 18290 - DNA, 368 bp, Homo sapiens
agagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagttaaaaaaaaaaaaaaaaaagc

SEQ ID NO: 18291 - DNA, 387 bp, Homo sapiens
  misc_feature 356: n=a, g, c or t
gttttccgtgagagacgtagagctgagcgasccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcctttcccatcaatcccagcccatgtactaataaaagaaantctttgagtagtcgaaaaaaaaaaaaaaaaa

SEQ ID NO: 18292 - DNA, 354 bp, Homo sapiens
aaataaggtggttctataatcagctataaaactctaacaggtgctcttgaatgcgggtttctgataactttggagactgtgtatcaaaatagaggaaaaactttcaggactcatggacagctaaaatgttcatgaatatcaagaagaacaggaatatactacatggactgaactaatctttttgacttttttgcttaaaacgtttgctgatcctttgttttgtwtttcagagtcktaatacctttatyttatgctaktgacagcttctaacaactcagtatactcctatgaacaaaatttggagcatatttgtwtcwctctacctgatttcttcagactgtggaaactatttga

SEQ ID NO: 18293 - DNA, 439 bp, Homo sapiens
aaaaaggaatgaactatatggactgaactaacatttttgactttttgcttaaaatgtttctgattctttgttttgtttttcaggtctcaaaacttttctttkggagttattgatagcttttaacaatttattttactcctaaggacaaaatttggggcatatttgtttctctcgacctgatttctgcagaatttggaaactatttcatttagtggtcctgaacagaaagtggaaagacacagcaattcaatccccccaattttggggatctgctgtgcacactaggttctttcttaatccctgctgaggaacttgagaagcagcagcagcaccaaaaccaaggcatgcaccggattcaaggttctttttgttccagttgtcagattccaaactagaccccaatgtattgcaagtatgaccaaataawaagccctgttta

SEQ ID NO: 18294 - DNA, 400 bp, Homo sapiens
tcttgtgatggtggctggcattttgctcactccttgtaccccttaggtaagaatcacatgggcagatgacaggtaggttctgtgaagagcaaaattgaaatggaggctgggtgcagtggctcacacctgtaatcccagcactttgggaggccgaggccgaagatcatgaggtcaggagatggagaccatcctggctaacgtggtgaaactcgtctctactacaaatagaaaaagttatccaggcgtggtgtcatgcgcttgtagtcccagctactcaggaggctggagcaggagaatcgcttgaacccagaaggcagaggttgcagtgagccaagatcgcaccactgtactccagcctgggtgacagagcgagactccatctcaaaaaaaaaaaaaaaaa

SEQ ID NO: 18295 - DNA, 340 bp, Homo sapiens
agggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccagtgagtgcgggcaagtatgagacagtgtggggggtggs

SEQ ID NO: 18296 - DNA, 465 bp, Homo sapiens
attttcgcaatggagcacgaagaaatttacatctgagtcccagggcaagcggactgcaagcaaacactgccaataaaaatggcaagaattatttcattaataaattataatagagactcaaaacctgctactgccaggcaaagcaggtttttagcccatgttgtgtaatgtcatacttgtagaggcacccacacccttggagcccaaaaccatgccatgacatgtaaccaaccagctacatgtgaagatcacataaaggtgttcttgtcctggctctagctaaggttccagctctcagtcagcatcaattgtggaagatgggagtgcatgagcttttagatgakacagtcccctgcctttgacaccaagtggaactgagatgatctttccaccgagccctagtcaaactgcagattcatgagcaaaataaacaccatcattactgaagcagaaaaaaaaaaaaaa

SEQ ID NO: 18297 - DNA, 426 bp, Homo sapiens
attcacagcccttttctccccctaaggatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactg

SEQ ID NO: 18298 - DNA, 128 bp, Homo sapiens
agcatactgagtgggcttgcgagtcgattgctcctgagtttctgtccctggttccctctgcatggcgtggagagatttcagtcatggttcagttgagggggctgaatctcctcttttttttttttttt

SEQ ID NO: 18299 - DNA, 425 bp, Homo sapiens
attaacttactcaaaacacactgatacatagttctataataaatcatacctttaacatgttttcttatacagaatacagcaataacctccaagaggacatttattcagagacctcgggacacttcagagatactctcatgaacttggtccaggggacagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaataaaatgtgattcctttgaagaggaaaatgaataatacattgaattagaaacataaataaaatgaccagtaattgtgaaaaaaaaaaaaattaaaaaaaaaaaaaar

SEQ ID NO: 18300 - DNA, 494 bp, Homo sapiens
acctttttgactagaaataactgatgaaagttcacttagtttggtgggaaataagagatacaaagatatcttctccaggatgagactcccaaaagcaaatgttctctgagtacctctgtcgctcaaatttaagccctttggagttcctttgagcatggttctgccctcatatttctgatcactccctctagactcctactcaacttctcttcctctgagcactccaattgcaagtcacacccagagacagggtcttgttatgttgcccaggctagtctcaaacacctggcctcaactgatcctcccacctcagcttctgaaggtgctgggattacaggcatgagccaccacaagaacaacacatttctataagctgcattggggcttacgagaaaggagacaaaagagactgcccaacatgcagaggctgagaggagacctacacataaaccagaaagccttatatcttcagtgaaaagtgaacaacaatagca

SEQ ID NO: 18301 - DNA, 65 bp, Homo sapiens
gctctgctccgagccgctcactgcatggtagagtctggtgcccccgccgccgcctgcatcgccgc

SEQ ID NO: 18302 - DNA, 239 bp, Homo sapiens
agagtctggtgcccccgccgccgmmtgcatcgccgccaccgrcgytccgscacgaccaccgccgcctcctgccctgcagccaccgccaccgsctgtgtmgccgscgyctcrggaccggmtgtatgattaggccacaatcttcaatgagtaaacatattcctcaattctgtggtgttcttggtcacacatttatggagtttctgctgggctgwgaaggagaataaagagttaaactgtcw

SEQ ID NO: 18303 - DNA, 519 bp, Homo sapiens
tgttttcttttcaatctcagctcttgtatgtggaaataatgaaataatatttgctatgagtgttggttggggttttttgttacagatactaagagttattctagtagtgtaagcagcaagtgatttattaagggtgatagctagtttagcacattgggcaggctgacaaaagagactgtactctgagtttctgggaatggttgccagttctgcactgtggaaaagcctgctgaggagctgctgctactgataaagtcagggtgctgcaaaccaggaacccaagcaagactcaccccccttcttccactttccctacataacaccgttctgaaggagccccatgtggtatgtctggttggtggaactaattaacatgtctgcttgtatacccccaatttgcttatttgctttctttttttaaattctatattgggaagtgaggtttacacagtaaggaagtagtgaaaacataacaaagatgatttggggctcatgaataacagatacttattacagtat

SEQ ID NO: 18304 - DNA, 535 bp, Homo sapiens
aggatgggaggagcatggagaagccaaatatgtaggaaaggcatcctcttcttaactcagactgctgagtccctaattaccagctgcagaccaccaataagggtggagcaccatgcctggacatagtggccatgcttttatatttggactggacaaaagggatcttgataagagtttagccttggaaggactcctacagagagcatctatgacccccaaagacagatttcaggcctactaaaagtctctttctcatgagacacttacccattgatcaaatgacttctcattcatggtgttatcagtcctgttacaatgttgtttaacctgtaacatggatataatatctgccctgccttcattttaggattctagggaagtgcttggaagagcaccaagtgcaatgcaactatagggttattaataatgttgctattatacattttgattgatgagattttgacaatgggaagccccctctctccccactctggccacaggacctgttcctaaacgtacatctcagtccacactc

SEQ ID NO: 18305 - DNA, 512 bp, Homo sapiens
actaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtkgagcagacacaagtcaatgattgcagtatagccactgaagtaatctaaaagagacttatcagcaggttgcaggtgaacatggccttgaggtaaatctgtcccttgctgaatacagtttcagtagattgttta

SEQ ID NO: 18306 - DNA, 438 bp, Homo sapiens
agtggatttactaggaaggtgggacgttggaggggtggccgcatggagtgagtactgtctctggccaccgagcagagccagtgamaacagcgtcctggwargcaggcaggcgtatcaggtttcagaggatgcggctgggaacgggagtagaggtatatgagctcsvtgaaagcacaaagcagttatttccatcttcagatcattcagagattatgaaggcacaaaccctgccttcaatttgcttatagtcaagtggagcagacacaagtcaatgattgcagtatagccactgaagtaatctaaaagagacttatcagcaggttgcaggtgaacatggccttgaggtaaatctgtcccttgctgaatacagtttcagtagattgtttatagtagtttcaggaattgagattttttacaraartacaaaagttttgsttg

SEQ ID NO: 18307 - DNA, 196 bp, Homo sapiens
cccccaccccctctgacccttccatgaggcacaccagggctggttccttctaattgctaggcataactccaacctatttagtcctcaccttcctcattaacagagtcaaatctgggccccaatcataaaagtctgaccgggttgtttccttcttaaatcccttttgttttcccattctcctcaggataaggcacaa

SEQ ID NO: 18308 - DNA, 503 bp, Homo sapiens
cctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggcatctccactcccagggcatcatctaccgggacctcaagcccgagaacatcatgctcagcagcagggccacatcaaactgaccgactttggactctgcaaggagtctatccatgagggcgccgtcactcacaccttctgcggcaccattgagtacatccgccctttaccgcagagaaccggaagaaaaccatggataagatcatcaggggcaagctggcactgccccctacctcascccagatgcccgggaccttgtcaaaaagttctgaaacggaatcccagccagcggattgggggtggccaggggatgg

SEQ ID NO: 18309 - DNA, 426 bp, Homo sapiens
agttggaagagtactggccctgggaagacccagctttgagcctcaggttgtgtctaatcatctctctgtccttgggccagtcaactcacctgttcgtgctgccacagagacagaggggccacatcagagagaaagactctacagcttgcccagagtcgagcttaaatggagcagcatgatttttgtctgaaaagtctgagatgggaccagtggaaaggtgtgcattttaagaaggawttgcttccccatcttgtgctttctgtgtcttgcagcacgacctggccvtccacctaggaatcataccctcatcccccatactcataagcatcctcattcctgtttccttgtggatgtcatggtctgctgtgaagtctgcttggtgacccgtccagacctgacttggtrtaaatgattttgttgcagaga

SEQ ID NO: 18310 - DNA, 487 bp, Homo sapiens
cttttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgagagattgggtctctccacattgccccggctgctctccaacccctgagttcaagtgattcacctcccttggcctcccaaagtactgggattacaggcgtgagcaccgtgcctggctgagaagatggatttaagacatattttggaggtaacattgtcaggacttcctgaaggattagatgtggaagggaaggataagaaacagaccaaggataactttcaaatgtatgcttaagcaactggatg

SEQ ID NO: 18311 - DNA, 168 bp, Homo sapiens
gtgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggt

SEQ ID NO: 18312 - DNA, 444 bp, Homo sapiens
gtgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgaaacttgcatagtgactaatgaagaactcttc

SEQ ID NO: 18313 - DNA, 452 bp, Homo sapiens
  misc_feature 19,102,145,187,239,254,263,297,305,333..334,337,339,343,357: n=a, g, c or t
gtgtggtgadvtcaattantttacctgagtagabtactgaagcagcatttgaagctgcagtcttgaaacacatgcaggctggaaaagtcgctaaagaattanttatttgagatggyacatgtttctgcagaaactcaagatgttntcctaaagatgaatcaactggttcaaaagcctcctctgggtntccattgtgtgaacacataatccctggggattcagamttaaggtksaatgantgaatcaatgatttnaggttttgncacaaggatccttgataaaaaggscasattatantttatgtntctgagccagataaagataatgattttnnttntntganvtttcccagtaaantttggaaaatagctgaaagtgascaattcaagtstaattcataggataagaatgaaacttgcatagtgavbtaatgaagaactcttcaagaaaga

SEQ ID NO: 18314 - DNA, 422 bp, Homo sapiens
gtgtggtgatctcaattactttacctgagtagactactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgracttgcata

SEQ ID NO: 18315 - DNA, 362 bp, Homo sapiens
gcccactggagctctggagggtgggacatccccaaacctaaactgttaactgagacctggaactgtagctgagtcatatattcttcttctttttttgagacggatttggttcttgttacccaggctggagtgcagtggcgcgatctcggctcactgcaacctccgcctccccggttcaagtgattctcttgcctcagcctaccgagtagctggggttacagacatgcgccaccacacctggctaatttttttgtatttttattagagacagggtttcaccatgtctactaaaaatacaaaaattagccakgcgagttggtgtgcacctgtaatcccagctacttgggaggctgaggcaggag

SEQ ID NO: 18316 - DNA, 472 bp, Homo sapiens
  misc_feature 361,374,378..379,381,442: n=a, g, c or t
gcccactggagctctggagggtgggacatccccaaacctaaactgttaactgagacctggaactgtagctgagtcatatattcttcttctttttttgagacggatttggttcttgttacccaggctggagtgcagtggcgcgatctcggctcactgcaacctccgcctccccggttcaagtgattctcttgcctcagcctaccgagtagctggggttacagacatgcgccaccacacctggctaatttttgttgtatttttattagagacagggtttcaccatgtctactaaaaatacaaaaattagccaggcgagttggtgtgcacctgtaatcccagctacttgggaggctgagggcanggggaaatsggcnwahnnrnccrhggaagtggaggttgcagtgagctgagatctcgrccattgsactccagcctgggsggncaggagcaaaactctgtcccaaaaaaaaaa

SEQ ID NO: 18317 - DNA, 454 bp, Homo sapiens
ctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttaa

SEQ ID NO: 18318 - DNA, 301 bp, Homo sapiens
attaccatcatgatggcctgtcaggcttttcagagaagaaatgaactgattaaccacaaatgcattattccaacaagccaaaagtcttccatcccatgggccagggtaattttcccaggttagatccagggtttgggtgaaatttaactttaagatgtgggtgccaaaagagagaattggcttgtggggcctttcaccagagacccatgccagtgactgaatgacctggattaggtatgcatacttgcaagcctcttatttgggaattacactaatggttacctgttttgtgtgaccaaaa

SEQ ID NO: 18319 - DNA, 590 bp, Homo sapiens
cttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctatatttcagttgagctgctgttttcttccatgcaatattgtatactcaattgtgtatagaagaagctggtgagagtgccctcctacataaataagcaattgcagtgttttgcatgcaaaatataaaa

SEQ ID NO: 18320 - DNA, 478 bp, Homo sapiens
agatttcctgttctaccccaaactttggaatgtgctgaaaaaaccatctcacttcctacctccaagacatcaaagttgcaccttgaatgatactccacatcgaagtcatggatggatcttgcyatattgcccaggctggtcttgaactcctaggctcaagtgatccacctttccctcccaaagtgctgggattacaggtatgagccaccacacctggccgtgttttgtatcctcacaagactttatccccagatttgagacaaagacttggagctagaagaggaattactggttaaaaagctatcatgaatagctagagaagagcaatgcgcccctccgccccaacccacatattattgctacttgaacctaaagaaagaatgaattgtgtcacttagtgggaagcctttgaaactggatcaccatttacttggttacccttgggataagctgcccatgacaacgaaacataaaaatt

SEQ ID NO: 18321 - DNA, 154 bp, Homo sapiens
tatttttgatcagtggcctttgggcactgttcagggtactgaccatcagtgtcagcattagggttttggtttttgtttcttttgggtatttcttttttggcacatgtgaatcttgttttgtgwaaaatgaaatacccaaaaaaaaaaaaaaaaa

SEQ ID NO: 18322 - DNA, 436 bp, Homo sapiens
caatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacacctataacacttcctgtgtgagttcatgtacctgtctgtgagtgctttggtgtattgagccctcagtacactccaagggcattaaagtcaagaaccaaaaaaaaaaaaaaaa

SEQ ID NO: 18323 - DNA, 517 bp, Homo sapiens
tatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaaagttataattattaattatagttttttgtgtggtaaagcaaagatactgtgata

SEQ ID NO: 18324 - DNA, 461 bp, Homo sapiens
tgtacttccttagtactggtagcattattatccaatggacttttatagctttcattaggttttcttttgtttttgttctttaaagaacgttttacttatcttagtatttcatttttcatcyatattatgaggcagtaagagtcttctgtttttccaaagttgagactgctttatatttatttcgtattgtctacagctgtagtgttcaatacattagccactagccacatgtggttatttaaataagataaaataaaaattggccgggcgtggtgggtcacgcggtaaycccagcactttgggagsccgaggcgggcagatcattaggtcaggagatcgagaccatccttactaagacggtgaacccccatctctattaaaaatacaaaaaattagccgggcgtggtggcgggcgctgcagtcccagctactcaggaggctgaggcaggagaatggcgtga

SEQ ID NO: 18325 - DNA, 402 bp, Homo sapiens
tgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaaaaaaaaggc

SEQ ID NO: 18326 - DNA, 109 bp, Homo sapiens
acttccttctcgagcccggagccgctgccgccgcccccatgcttctggggacctttcctacccccatcagcatcaataaaacctcctgtctccgaaaaaaaaaaaaaaa

SEQ ID NO: 18327 - DNA, 139 bp, Homo sapiens
attttcaaggggctgtgaaaagagagggtcactcctttttgatcatttccctgctgcctggcttcaaatggccctcaggcaggtcactttagggaaattggtgatcgctcttggtattccactttttttttttttttga

SEQ ID NO: 18328 - DNA, 242 bp, Homo sapiens
acacacacagacagggaaaaaggccacgtggggatgactgcagagagtgaagtgatatgtctacaagccaaggaacgccaaagactactagcaaccaccacaagctaggaagaggcaaaggattctcctgtaaagccttcaaagggagcacggccctgctgccaccttaatccagaattccagcctccagaactgtgagacaataaatttctattgttttaaaaaaaaaaaaaaaaaaaaaa

SEQ ID NO: 18329 - DNA, 276 bp, Homo sapiens
acacaaacagacagggaaaaaggccacgtggggatgactgcagagagtgaagtgatatgtctacaagccaaggaacgccaaagactactagcaaccaccacaagctaggaagaggcaaaggattctcctgtaaagccttcaaagggagcacggccctgctgccaccttaatccagaattccagcctccagaactgtgagacaataaatttctattgttttaaaaaaaaaaaaaaaaaaaaaaaaaaaaaaaaaaaaaaaaaaaaaaaaaaaaaaar

SEQ ID NO: 18330 - DNA, 261 bp, Homo sapiens
acacaaacagacagggaaaaaggccacgtggggatgactgcagagagtgaagtgatatgtctacaagccaaggaacgccaaagactactagcaaccaccacaagctaggaagaggcaaaggattctcctgtaaagccttcaaagggagcacggccctgctgccaccttaatccagaattccagcctccagaactgtgagacaataaatttctattgttttaaaaaaaaaaaaaaaaaaaaaaaaaaaaaaaaaaaaaaaaa

SEQ ID NO: 18331 - DNA, 283 bp, Homo sapiens
aacttaaattaaaggggccgtctgaaaccagaagactggactggaggcgaggaaaaggaggcgaggggaggggagggagaaaagagagttatttggaggttttttcccgcctcctctaacttggcagagagaggagatggttcagtgatggacgaaaagatgagaagacagagaaaatagaggagataaagacaggataaaaatcacattaaacatggaaaacaaaaacaaaaaccacagtgggacaacaacagggacagagcaaaaaaaaaaaaaaaaaggc

SEQ ID NO: 18332 - DNA, 191 bp, Homo sapiens
atttttctgtattagctggttattgttacttgagatttgtcagctttccttgaagtgtgttcccttgaactggatgctaatgtttgccatgcagggaagaatgtctctgcagtaaaataaagttaaaatcagtttatttactgcaaaaaaaaaaaaaaaaaaaaaaaaaaaaaaaaaaaaaaaaaaaaaaa

SEQ ID NO: 18333 - DNA, 173 bp, Homo sapiens
atttttctgtattagctggttattgttacttgagatttgtcagctttccttgaagtgtgttcccttgaactggatgctaatgtttgccatgcagggaagaatgtctctgcagtaaaataaagttaaatcagtttatttactgcaaaaaaaaaaaaaaaaaaaaaaaaaaaaaa

SEQ ID NO: 18334 - DNA, 98 bp, Homo sapiens
atttttctgtattagctggttattgttacttgagatttgtcagctttccttgaagtgtgttcccttgaactggatgctaatgtttgccatgcagggaa

SEQ ID NO: 18335 - DNA, 473 bp, Homo sapiens
acttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctcactttctggtggaggtgatagccaacagtaagatggccaaaagctacttacccttgaagaggaaatgaagggcttggagctccaactagatagcctatgaataattgagatttggctttttacctcattatggatttagtttgaatgtattctgtgtatatattttaaggatatgttttcatgatgatgatgatagcactgatgagaggagtaattaaagcttctatttattgagacttgactatatgtcaggtactgtttcactttcatcaccagta

SEQ ID NO: 18336 - DNA, 468 bp, Homo sapiens
aaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcatggatggktttaaaggagtattatgattgtaaaattgctaaatatgactgtaacacagctttgtggtagctgtgacacagttcacttgggcaaaggagtggtgatggactcgtta

SEQ ID NO: 18337 - DNA, 552 bp, Homo sapiens
agcgtaggagagattcttctgtaattttgcgggggttcagccttgctcggcgattcacggcccagacatagagaatcgggatagctggccgaaccgtctctctcagtctgactctctttaaagaagggatgtgggctggggcgcggggacagtcctggtggagcacggaaaatgcggctgtaaagttgtaattaccctattgtgccgagttccgagaaagttcttaaaattgttaagtccactttgttctctaaaatgtacttcgctttgagaatttcttcagggagaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcactcctttatgtctccaaatgatacaagaagacccgagaaagtggtaaactaaatgatttttattaaagtaattgc

SEQ ID NO: 18338 - DNA, 237 bp, Homo sapiens
gcgccttcgtactgggcctgagaaggaaggagttattcatctccttaagctttcaggcctcagggagaatcgtacattcccgtctatttggttgtagataaaagagataaggggcctctttctcaataactacttcacgtgtgatatagggggtggtgtgggcaccttggaaaaacaaaaccttaattttttgggtattcttgagagacgggttggtatccacattgtccttgtagt

SEQ ID NO: 18339 - DNA, 490 bp, Homo sapiens
agaacactgctagtgttctctgcagtttgttgtagaatcatagtgtcttggcaaccaaaggcagatctggtgctatggaggacctgcttactgctatgaggtgttactttatagaggtcctggagaagctgattgaggccacgtcaatgttgcaaggagacatgagactcacatcagagttctatggcttaacatgggggatggtgtgaaaagaaacagagatcgttggagaaatgtctgattataagatatttctaagcctggtgaagaaatatataagagaagcctggagaagaaccagtaataccagaaatcagggaggggccctgaagagaaaaggataacaaaaggatgaagacctgtccaagggacccagcagctaacttgaaagagctctcaatgggtaaagctggagcaatttcaacaacaaaataataacatatcactggattataacctgaagtataaacgtatgagtccatactcttat

SEQ ID NO: 18340 - DNA, 592 bp, Homo sapiens
agttaggccacatcagcgcaaatctgtgagggtctagtaactgcctgagaaaatatcttgtctgaccccggttatatttttccttcggtagggattggactttctgaakgacgttgtgatccaaaggaaggaggccggagtctctacttcccatacagcagcctggtccgaccccagtggcactaacgtgggatcctcagggcgctctcccagcaaagcagtggccgcccgggcgcgggatccactgtccggcagaggaaaaatgccagctgtgggacaaggagtgcaggccgcacaacctcggcaggcaccggggggatrtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaatattgattttgagg

SEQ ID NO: 18341 - DNA, 413 bp, Homo sapiens
atgcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatgtatacacaaacccagaagatc

SEQ ID NO: 18342 - DNA, 72 bp, Homo sapiens
ctttttgttgctgccgccgccgccgagtgtcactttcagcgccgccgcctgcgtctcccaggccgtaaccac

SEQ ID NO: 18343 - DNA, 60 bp, Homo sapiens
ctttttgttgctgscgccgccgccgagtgtcactttcagsgccgccgcctgcggtctscc

SEQ ID NO: 18344 - DNA, 115 bp, Homo sapiens
cattttgttcatcctcctcctcctcctgctcctcctggttggagcgcagtgtccggagcgggctggggggagagagcccgagagcagggttcggtgccttttcctctgtccccac

SEQ ID NO: 18345 - DNA, 478 bp, Homo sapiens
aaagggtgtgaaccggaagcgatttcatagccacggtttttggctttcatcgctttttctacatgtttttagcctcaccagaagtctttcatcacggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacataga

SEQ ID NO: 18346 - DNA, 391 bp, Homo sapiens
aggagacgccatgccgggggctgggatcaccatgccccttgcccgtctcgcaccttgctgctgtctctaaccccccagcacctcccgcagcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcactggacgttggaggaaagaaggaaatatctcattgcaggaaaggccga

SEQ ID NO: 18347 - DNA, 351 bp, Homo sapiens
aacggggcggasgcggctgcscggcgcgtcgaggggagaggcagcagccgcgrtggacgtgttcctcatgatccggcgccacaagaccaccatcttcacggacgccaaggagtccagcacggtgttcgaactgaagcgcatcgtcgghrrgcatcctcaagcggcctcctgacgagcagcggctgtacaaggatgaccaactcttggatgatggcaagacactgggcgagtgtggcttcaccagtcaaacagcacggccacaggcccagccacagtggggctggccttccgggcagatgacacctttgaggccctgtgsatcgagccgttttccagcccgccagagctgcc

SEQ ID NO: 18348 - DNA, 440 bp, Homo sapiens
aggaagaggccgcgtggggcgaaggcggcgcttggctggatctatcttgggatcccatggctttctttactgggctctggggcccttcacctgtgtaagcagagtgctgagscatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtgtcctcattgaggacaacgggaaccctgtggggacacgaattaagacacccatccccaccagcctgcgcaa

SEQ ID NO: 18349 - DNA, 71 bp, Homo sapiens
attccttttagttattaggtattcgtagtatggtccagcaatttgacccctgatctctgcttttttttttt

SEQ ID NO: 18350 - DNA, 544 bp, Homo sapiens
ctctccgcgcgccccctgcagccctggacgcagcacctccgtttgggacgccctacgcccaccttaacttgaggctcccatccamgccagcctctgcargcctcaccgcaaccgtgctaggcgcgtcggvtggggcgggaataaagtttttccaacccagtttggggagagggctggatgggaaggaccctccctgctgcagacttcatggcaggctgcactgtgtcccctcggctccacggctgccccgggggcgctgctttcgggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagc

SEQ ID NO: 18351 - DNA, 465 bp, Homo sapiens
agcagtactcaataaatgtatttcacatgttgaaaatgggtccttatgattgattatttagtttaatagtaaataataggaaaatttctttggaaaaatggaaatatagttaatttactgaagactggtaaaaattctctgtctttgatacttattcttaatttggctacttgaaaggcataggttgggccaggtgcagtggctcacacctgtagtcccagcactttgggaggccgaggcgggcggatcatgaggtcaggagattgagaccatcctggctaacgcggtgaaaccccatctctactaggaatacaaaaaattggccaggtgtggtggcgggtgcctgtggtcccggctactcgggaggctgaggcaggagaatggcgtgaaccccggaggtggagctcgcagtgagctgagattgcgccactgcactccagcctgggcgacagagcgagactccgt

SEQ ID NO: 18352 - DNA, 464 bp, Homo sapiens
gaaatctgggccaggcacggtggctcacgcctgtaatcccaacactttgggtggccaagacgggcggatcacctgaggtcaggagtttgagacaagcctggccaacatggtgaaaccccatctctactaaaaatataaaaatttgacagccatagtggcgcgtatctatgatcccagctacttgggaggctgaggcaggagaattgcttgaacccgggaggcagagtttgcagtgagctgagatcacaccattgcactccagccttgacaacagagtgcgacgccatctcaaaaaaaaaaaagaaaggaaagaaatgacatgtgtttggatgggycatgawagttgagaaaaagctggatttcagagctatgtcacacctttttatcatcatcaggatctagcatggggctttatacatrgtaaatgcttaattagkatttattgrgtatacagatgtttttat

SEQ ID NO: 18353 - DNA, 417 bp, Homo sapiens
catgttgatcctgaagaatccgttaaaatggtagcacaagagtctggcaagttggtactgcagagaaaaggggttaattgaggcttgtttggagtcgggattcccctttcccaaacatgcgtctcgccacttggacagcagccatttgtactcgtatactttttaaactttttcttggaatactatattttatttgactggtagtctgatattactcctaacttgtcaaattgatctctttgcaggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttc

SEQ ID NO: 18354 - DNA, 495 bp, Homo sapiens
tcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgcctgacacgtgcagctgtaagaggggtgaacggataccctctgcatgaaataaacttcctttgcagttaaaa

SEQ ID NO: 18355 - DNA, 503 bp, Homo sapiens
tcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgcctgacacgtgcagctgtaagaggggtgaacggagtaccctctgcatgaaataaacttcctttgcagttaaaaaaaaaaa

SEQ ID NO: 18356 - DNA, 518 bp, Homo sapiens
  misc_feature 214..215: n=a, g, c or t
tcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctsnngaaagcatggcacctgaaatttctgaagatattggctgtcctctagcttatatgagagagtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgcctgacacgtgcagctgtaagargggtgaacggagtaccctctgcatgaaataaacttcctttgcagttaaaaaaaaaaaaaaaaaaaaaaaaaa

SEQ ID NO: 18357 - DNA, 165 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcac

SEQ ID NO: 18358 - DNA, 521 bp, Homo sapiens
gcttagatttcctattggcttagagtatttgctataacaaatgaagtgcaatgacaattatatattcctactcggtcatactggactggcttcgttctcttaatatactcagtaatgactcaagcctctggtattaacataccctagttgccgttttttaattgccatgagccaaatacttcttgtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaagtgccattcttatgagccaaaagtttgtcatttaaaagttcattttgagggaataacatgtaatataatttgaaataaagggtatagtaaccttaaaaagaacattataactgattgttgtg

SEQ ID NO: 18359 - DNA, 424 bp, Homo sapiens
ctcctgtctactgaggaagcgcmkkaaggcactattcccactgttttctttctctctcagcaggtttctcagcccccgaggattcacgatcatctttgggaggagagggccactcacatcctcccaactaagctccatgttggccaactgggaccacacgcctcgggcaacgtccaagggaaaggcgatctgggggcaagaggcatgaggttcgggcacctccagcagaggcggacttccagccacggcccccacctgggcagagggaacgtctccagacctgtggaaacaggaggagggcagagcgacggtgggaggggggtcgcattcaattgtcccagtagaaagtcctgatagtgccgttcagctcagctctgcagggcagacccagaccctgagtaaggaaatgtgcgaatggagatat

SEQ ID NO: 18360 - DNA, 404 bp, Homo sapiens
caggacacaataaaaatcacttataagacaaaagaactaggaaatcataacctgaatgagagaaagacaacagacaccaacacagacataaaaaaggggttggggctgggcgcagtggctcacacctgtaatcccagcactgtgggaggccaagatgggtggatcacttgaggtcaggagttcaagaccagcctgtccaacatggtgaaaccccgcctctactaaaaatataaaaagttagctgggtgcattggcacatgcctgtaatcccagctacttgggaggctgaggcaggagaatcacttgaacctgggagatggaggttgcagtgagccaagatcataccgctgcactccagcctgggtaacagagtgagactgtttcagacaaaaaaaaaaaaaaaa

SEQ ID NO: 18361 - DNA, 224 bp, Homo sapiens
ctctgtgattgttctggagtgaattaagttcacctgataactcaaaagtgaatgtataatacaattctgttttaatctgtgtattctttttctcctactttttactggggtgagaggggcatgaagagaaatacgcctttttttttttttcttttcctgtsgcaaaggctcgaytgagagaagtcagaasagagaaggggaaaaaaaccccaaaattatgtgaa

SEQ ID NO: 18362 - DNA, 307 bp, Homo sapiens
atatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcacgacaacacacaaaaa

SEQ ID NO: 18363 - DNA, 250 bp, Homo sapiens
atctttgatctttctwgtaagtgcatagaagaaaacgctgacgtatgcwgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaaaaaaaaaaaaaaaaaaavmaaaaaaaaaaaaaaaaaaaaaaaaaaar

SEQ ID NO: 18364 - DNA, 389 bp, Homo sapiens
cttttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggargagaaatttttatttttgaacccctgtgtcccttttgcataagattaaaggaaggaaaagtaaaaaaaaaaa

SEQ ID NO: 18365 - DNA, 382 bp, Homo sapiens
cttttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggtgatccagttctaagtgtcatcttttattatgaagacaataaaatcttgagtttatgttcaaaaaaa

SEQ ID NO: 18366 - DNA, 358 bp, Homo sapiens
cttttccgcgccgatagcgctcacgcaagcatggttaacgtccctaaaacccgccggactttctgtaagaagtgtggcaagcaccaacccctttatgacaggaagcagagtggctatggtgggcaaactaagccgattttccggaaaaaggctaaaactacaaagaagattgtgctaaggcttgagtgcgttgagcccaactgcagatctaagagaatgctggctattaaargatgcaagcattttgaactgggakgagataagaagagaaagggccaagtgatccagttctaagtgtcatcttttattatgaagacaataaaatcttgagtttatgtccaaaaaaaaaaaaaaaaag

SEQ ID NO: 18367 - DNA, 203 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaa

SEQ ID NO: 18368 - DNA, 221 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaaaaaaaaaaaaaaaaaaaa

SEQ ID NO: 18369 - DNA, 405 bp, Homo sapiens
ctttccgcgccgatagcgstcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagagtctaagagaatgctggctattaaaagatgcaagcattttgaactgggaggagataagaagagaaagggccaagtgatccagttctaagtgtcatcttttattatgaagacaataaaatcttgagtttatgttcaagaaaaa

SEQ ID NO: 18370 - DNA, 401 bp, Homo sapiens
ctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaagggcaagtgatccagttctaagtgtcatcttttattatgaagacaataaaatcttgagtttatgtccaaaaaaa

SEQ ID NO: 18371 - DNA, 225 bp, Homo sapiens
atctttgatctttcttgtaagtgcatagaagaaaacgctgacgtatgctgccttctctctctctgcttcggctacctaagagggaagggccccctgtgctgtgatcacgtgacttgcttcaccttgtcaatcacttagaagattcaccctcctgaccctgtgcacattaaaaacttgaaaagcaaaaaaaaaaaaaaaaaaaaaaaaaaaaaaaaaaaaaaaaaa

SEQ ID NO: 18372 - DNA, 285 bp, Homo sapiens
agttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaaaaaaaaaa

SEQ ID NO: 18373 - DNA, 279 bp, Homo sapiens
gtccctaagctctcgccgtagcagccgccgcccatccctctttgtgtgctttggaaagccgcggastggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggaaaaatcagagaggaaaagaagagaaaagaagaacaaaaaaaaaaaaaaaaagg

SEQ ID NO: 18374 - DNA, 58 bp, Homo sapiens
gccgtagcagccgccgcccatccctctttgtgtgctttggaaagccbggastggtggt

SEQ ID NO: 18375 - DNA, 172 bp, Homo sapiens
aggaggggctgggggtgaggggccacgcatggccaaggggcagctgcccctcatttatcactctgaccttcacagggacagatctgatttatttattttggttaaaaaaaaaaaaaaggawcagaaacaactttgcattgcattggcttgacccataaactaagttatatcc

SEQ ID NO: 18376 - DNA, 202 bp, Homo sapiens
aggaggggctgggggtgaggggccacgccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtgggaaaaaaaaaaaaaraaaaaaaaa

SEQ ID NO: 18377 - DNA, 116 bp, Homo sapiens
agagggcggtggctcaggctcctggaaaggaccgtccacccctccgcgctggcggtgtggacgcggaactcagcsgagaaacgcgattgagaaatgaaaaaaaaaaaaaaaaaagc

SEQ ID NO: 18378 - DNA, 460 bp, Homo sapiens
attgcgtagggtcttgcgcagcgcgaaaagtagcgtgggccaggacagcgggagcaggtcttgcccttggcctggtgtggtggttcatggctgcaatcccagcacattgcggggcggargcgggaggattgcttgagcccaggagttcaagaccagcctggacaacaaagtaagaatcagtctctaaattaaaaaataaaagtaatttttttttgtttttttgttttgagacagagtcttgcactatcackccaggctggagtgcagtggcaccgatctcggcttactgcaacgtccggctcccgggttcagacgattctcctgcctcagcttcccgagtagctgggattacgggtgcctgccaccatgcccagctaatttttgtatttttagtagagatagggtttcaccatggttggccaggctggtctcgaactcctgacctcatgrtctgcccacc

SEQ ID NO: 18379 - DNA, 437 bp, Homo sapiens
tctgtaattggcaccatccacaatagcttttttctgttctgttgtcacggtaacagatgcatctcgagcacttccagagtttggagaagttgaaatctcttctctgccagatggtactacctttgaggatatcaagtcactgcagagtctttatagagagcactgtgaggtaagtcttttcaaatgtagtatgaacacatgcwaggttttgccagataacttgctaatataaaataatcaagcttattcctaaaggacaggtgaacttagcactaattcttttgagcgtatcttttagcactaacaaattcatttttcttctttctggtctcagagtggagagatgaggaatgcagaaaagtgagaataagttttattctctatttcttaagcctatcctaatatgaatcctttggcgtakcaattccacctctagg

SEQ ID NO: 18380 - DNA, 492 bp, Homo sapiens
tgtttttgtcagctaatgcaggctcagtgactttaagtctgtaagttacccaggaagaaggattataggaaaaataactcagtaagtttaaaaccaaacacatttccatttagtgacaggaatttaagcaaggacctgaagtagaatcaactgattcacacagtagtaaatacaaagtagaacaatgatcttggcttcgctgtctggttcagtggtctgctggaatgcaatacacaagttaagtcacactgcagactgttttctagctgtggccgctggatgccacttctagcatagtagaactatgttaggaggaatgggaaaagtgagcaccacttctcaccatgttcccccctcctgctgccagtctctgctcccatgttggatgcagcagagatcacccaccagttggcccaggacagaccaataggaagggtccaatcactctaactacagccgaactcacctccacaacagtctctgtggctctag

SEQ ID NO: 18381 - DNA, 498 bp, Homo sapiens
tttatggggtaggtgattttgtttagtttagtattaaggcagatggttgtacatgtgcagaactcctttctgctaatagccaggatgaggctatatgagatcacatggggttaggccatgaggcaaggttccattcttcctctgccattcaaaagtgatagggctttggatagtttaattcatctctttgagttatcgttttccaaattgtaaaatgtaaataataatacaatctgccttatagggctgttatgaagattaaatgggataaagaatgggaaaaatactttgaaaactctagtgtggaaatgaggacaattgttcccaagctggtgtcctcttagtccccttatgttctcatcattattgtgttctttattcctttattatcattttaatagtctggaagttgagataaatgcatgcttttcatcagtctatgaratcaaaagttcttattcttaaaataatattaactttattcttactatgtaatta

SEQ ID NO: 18382 - DNA, 250 bp, Homo sapiens
attccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggctacttgtatcggtgacgccccaccggcccgcagcccctgctsccaataaaaccactccgaccccaaaaaaaaaaaaaaaaaaaaaaaaaaaaaaaaaaaaaaa

SEQ ID NO: 18383 - DNA, 256 bp, Homo sapiens
tgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttaaaaaaaaaaaaaaaa

SEQ ID NO: 18384 - DNA, 159 bp, Homo sapiens
  misc_feature 90: n=a, g, c or t
attgttctcggggccgggcgggccgcgagtcctgggactgcggcccgctctattcgtgcgtctccgtctccgcagtcagctccgccgaancggccaaggaagagcccaagaggagatcggcgcggttgtcagctaaacctcctgcaaaagtggaagcga

SEQ ID NO: 18385 - DNA, 97 bp, Homo sapiens
  misc_feature 60: n=a, g, c or t
gtagtgactcatctcgggcagagcgctagggctccgagcgaaccagccggagctcagcgnggacccacggcccaatcaaaaaaaaaaaaaaaaaagt

SEQ ID NO: 18386 - DNA, 478 bp, Homo sapiens
cggcactgactgggccctctctgacagtagcttgtacttaaaataaataatcagctgaaatgaatgaatgaatgaaaaaagaatatttgtggttttcattcaaagtagaaaagtgatgctatcaacattttttcccccttgtgaaggcactggattgatctatgatggtggaatgcaagaagtacatgttctaccatcagcaaacagttgacccccacctctgctagcaactggcgatggactaggtcctactgatgttggctatcttgcctcctggttgcttgactccaggtaactgataggaactcaaatgcttagagctcttaaaatttggaactaaaatccaagattttatagatttctccaaattgtggcaatgtgagcatatttccagataaagcaccttccatctgccactgtcttgtctatacataggccgtatatttgcagtgggggtgatatcacccccaaggggtga

SEQ ID NO: 18387 - DNA, 244 bp, Homo sapiens
taaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacagagtctcgctctgtcactcaggctggagtgcagtggcg

SEQ ID NO: 18388 - DNA, 497 bp, Homo sapiens
agtgacgcagcagtgtgttacctgccgacagcataawgygaggcaaggtcyagcygttccscccyggcatacaagcttatrgagcagccycctttgaagatctccaggtggacttcacagagrtgycaaagtgtrgaggtgwtcgagtgtggatcaagractggaacgtagcctctttgtgyccaykgtggaaaggaccccagactgtcgtyctgakcactcccacygctgtgaasgtagarrgaatccyagcctgatccaycacarccrtgtaaaacctgcagcgcctgaawcctgggaggcaagaccaagycyrgacaacccctgcagagtgaccctgaagaagaygacaagccctgctccagtcacacccrgaagctgactggtccacgcacagccgaagcatgaggaagctcattgtgggcttcatttttcttaaattttggacttacagtaagggcttcaactgttcttactcaaactggggactattccca

SEQ ID NO: 18389 - DNA, 485 bp, Homo sapiens
agatcgcaaaggaaaaaaccctggcgtgcaagcaccgataggagaggaaatgtttgctcagctgtaaaggagggagagaaaagggagaaagcacaggcggcgtggcaggtcttgtttcagtgagaatgtaaagtacgtgagctatgtgctttgtgatgaagtcgttgatttatttcactttggaacaagcacaccacaacaaagtgagaatgagaaggtaattcagagggagaagaaggaaacggaactgtacgtagaaatatatcctcatatgaacttagattctgaaataaatctaggttgtaaaaacaccaaaaggctgtttccatgagtgagtcaaccaagaggccctctcaggacttctgtgggacgttggaatcccctggcatatatgaaatccaaattagtcaggataggtaagattgtgctgcggtaacaaagaaaacctttattttcatggcttcatgctgaagcagcctcgctgt

SEQ ID NO: 18390 - DNA, 166 bp, Homo sapiens
atatcatccctgaccctgtgtctcsractgctgcaccccatcccgaccctgtctccgccacctcgcagccccattaaagcgctctcatctggaaaaaaaaaaaaaaaaaaaaaaaaaaaaaaaaaaaaaaaaaaaaaaaaaaaaaaaaaaaaaaaaaaaaaaaaaa

SEQ ID NO: 18391 - DNA, 95 bp, Homo sapiens
atatcatccctgaccctgtgtctccaactgctgcaccccatcccgaccctgtctccgccacctcgcagccccattaaagcgctctcatctggaaa

SEQ ID NO: 18392 - DNA, 427 bp, Homo sapiens
aaagaagaaaagatatataggtggctcacgcctgtaatcccaaagtgctgggattacaggtgtgagcactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacaccggtaatcccaatactttgggaggccaaagtgggaggatcctttgagccgaggagttcaagatcagcttgagcaacatggtaagacccctctccacaaaa

SEQ ID NO: 18393 - DNA, 388 bp, Homo sapiens
  misc_feature 294: n=a, g, c or t
aaagaagaaaagatatacaggtgtgagccactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacacggtrntcccaatactttgggaggccaaagtgggaggatcctttgagccgaggagttcaagatcagcttgagcaacatggtaagacccctctccacaaaa

SEQ ID NO: 18394 - DNA, 539 bp, Homo sapiens
ttgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtggtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccgtgttgcccaggttggtctcaaactcctgggctcaagcagtcctcctgcctcagcctcccaaggtgctggaattacaggcatgagcaccacgcctatcctagttaggttgctgatagagatctttcttgttttttgatgtgtttgtagctatacattttgctcttagtgcttgctttcactgcgtcccgtaagtttcagtatgttatgtttttgtt

SEQ ID NO: 18395 - DNA, 392 bp, Homo sapiens
aacattggggatttagtttacagcacatgaactttgggggacacacttaaaccatagtgccgtcttcagtctgagaagaatttctgtctttcattgaagttccaaaggcttcttattttgatgactttgcctaaagaagggattctacagccaaatgctttctttttaacataccgaatgagtaaaagtgcaaaataagtacagaactatcaaacagcaacaaatgtgcttctgctgcctaccacagaattttccttgcctcagagttgatgatgaatgcagtcctgctccactttgattccatctggctctggaaggtgtttctgaagatttgtgaacagcatttgaatttgtttgtttttatttatattggctttttactatgatgtata

SEQ ID NO: 18396 - DNA, 348 bp, Homo sapiens
ctttttcgccccgcccttcaaatgcgaaasgactgccttcttggacagggtgtcgccatgtttgccaggctggcctcgaactcctgacctcaagtgatttgcctgccttggcttcccaaagtgctgggattacaggcatgagccaccacgtctggacataaacccagtaattttgtacgatttataaaacaatgtagtctgcaggaactaaggctatgttttgcctcaaatgttctttgttttcagaataaaatacttggtcagtggaatctcttcaacaaaatagaagagaagcagtcatggagtgaagaaataaatcatctttgtttccaaaaaaaaaaaaaaaag

SEQ ID NO: 18397 - DNA, 361 bp, Homo sapiens
ccacgggctctccttgcatcagccaagcttcttgaaaggcctgtctacacttgctgtcttccttcctcacctccaatttcctcttmcaacccactgcttcmtgactmgmtctactcsgtggaagcacgctcacaaagttcctgacctggccatcccggggtgcccttraccagccccgtgtcwcctsagggtgtcccagacaccagcctggcacagagtggggctcagttagagtatctcgggatgttcgtttcgccaggcacgtgggccgtggcccggctgggtcggctgaagaactcgcggatggaagctgcggaagaggccstgatggggcccacsatcccggacccaagtcttcttc

SEQ ID NO: 18398 - DNA, 448 bp, Homo sapiens
acgtggcccggctgggtcggctgaagaactgcggatggaagctgcggaagaggccctgatggggccaccatcccggacccaagtcttcttcctggcgggcctctcgtctccttcctggtttgggcggaagcatcacatggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcagaaccctgaggcctaggggagctgttgagccttcagtgtctgcatgtgggaagtgggctccttcacctacctcacagggcttttgtg

SEQ ID NO: 18399 - DNA, 439 bp, Homo sapiens
tcaaaaagaaagtcatttgccttttctgggatttttcttccatgcccatgaaaacctgtgtcaagacacttctagatatatacacagacataagggtaatatggaagagtctctagctcagctaaggcatagatatctttggctcaggaaatccagtgatatcagcctttgattagggtagtagataacattttgtaacgataaataactgtcttacttggtgaaatgggtgtattgaggaagcaaataagtgaagatactttttcaaaagactttatgattcttgttacttgggaaaattttcccagaatgatagaccttgtaaaaractatttccatctatgtccctgaatttccaagccactgaagaaaaacaatacagaggttgaaaaaacctaattgttgcctacttacttggaaatgattgttgctggaaaaa

SEQ ID NO: 18400 - DNA, 183 bp, Homo sapiens
tcttttcggttattttctgctacggcagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccga

SEQ ID NO: 18401 - DNA, 96 bp, Homo sapiens
atctgccaggagaatttaactatagggagagtgatggaggtgctgggagcctggggctgagaaagtgtcggaattggtttaaaaaaaaaaaaaaag

SEQ ID NO: 18402 - DNA, 356 bp, Homo sapiens
tcatgaaatttcacccgcatttatgggttctttttaaaaattcagacaactggctgggtgtggtggctcacgcctttagtcctgacactttgggaggctgaggcagaggaatcacttgattccaggagttcaggaccggcccgggcaacatgatgaaaccccatctctgctaaaaatacacaaaattagctgggtgtggtggtgaacacctgtggtcctagctgcttgggaggctgaggtgggaggatcgcctgagcctgggaggtcgaggctgccatgagccccgatcatgccactgcactcaacctggatgacagagtgagaccctgtttcaaaacaaaaaaaaaaaaaaaaag

SEQ ID NO: 18403 - DNA, 137 bp, Homo sapiens
tttttttcgccccgcccttcaaatgcgaaasgactgccttcttgggtgagtgcattagctgggtagggtctgtcccggacctaactggatagtgtgggaagcagtggatcgttgtttcaaaaaccatttctttttgg

SEQ ID NO: 18404 - DNA, 391 bp, Homo sapiens
gaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcagatgactaaacagattgtcagtgtagaggaaacagccttccattggaagaaggtgc

SEQ ID NO: 18405 - DNA, 533 bp, Homo sapiens
  misc_feature 495..497: n=a, g, c or t
attatgataggacagaaagggaacatgggcagggacaaataagggaataaaagctggccaccccagccagcagtggtaaccggtttgggtcctttttcgcagtgtggagtcttcgtccttttgctcttcccaaaaaaccttgctgcctcttactttttgggtctgtgcaatctttaagagctgtaacactcaccgtgaaggtccgtggcttcattgatgaagtcagtgagaatcatgaagtcagccagagtactggtaggaaccaaccccagacacaccagcactttggtaggctgaagcagttggatcacctgaggtcaggagtttgagactggcctgactaagatagtgaaaccccgtctccactaaaaatgtaaaagttagccaggcatagggacggggacctgtaatctcaactacaggggaggctgaggcaggagaatcacttgaacctgagcgccagaggttgcagtgagctgaggtcgcatcattgannnccagcctgggcgacagagtgagactccgtctttgaa

SEQ ID NO: 18406 - DNA, 145 bp, Homo sapiens
aattagggctagaatggggctgatggaccatgaactacagttaaggaattggctttcattattatgggatatgtgcaagcttagtagaaatgaaaggctgaaaaagttaaaaagtgaagagctcagaaaagaagcaagasaatta

SEQ ID NO: 18407 - DNA, 187 bp, Homo sapiens
cctgtatggccctgtagccctgggcagagctgggcctgtcgtgtgttcctgcctggcagtgcaggtgctggccatctgcaggtggaaggaggtgggaatcttggattttttgtttttttttgtkttttttttttttgagatgaagyctcgctctgmcacccaaggctggcgtgcagtggtgtgatct

SEQ ID NO: 18408 - DNA, 503 bp, Homo sapiens
tattctttagtgtgtttgtatgtgcatgactatgcaagtagttttaaaaaataaatagccagccaggcacagtggctcacttctataatcccagcactttcgggatgctgaggcaggcagattgcctgagcccaggagtttgagaacagcctgggcaacatagtgatacccccatctctataaggataaaaaataggccgggtgtggtggcttatgcctgtaatcccagctatttgggaggccagggcggggggatcacctgaggtcagcagttgaagaccagcctggccaacatggtgaaacccgtctctactaaaaatacaaaaatccgccgggcgtgatggctcacgcctgtaatcccagcattttgggagaccgaggtgggtggatcatgaggtcaggagatcgagaccatcctggctaacacagtgaaaccccgtctctactaaaaataaaaataaaaaaattagccgggcatggtggctggcgcctgtagtccagct

SEQ ID NO: 18409 - DNA, 315 bp, Homo sapiens
actcttgtctgcttacgagggctcctcccttcagctttggtccctcggggcgtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctggtatgacagctgaagatgttgaaccgtatggtgcagttttgcaaatagtgtatgaagtgggttgtaagttttaccagtaa

SEQ ID NO: 18410 - DNA, 499 bp, Homo sapiens
cttcagctttggtccctcggggcgtctgggcagcctacgctttccgaagtacagtctatataaagactgtccaggacaaaaactggccactccattcagcattgacagcagtatttaaagctggtgcatggtgaggtgaagtttctcaagggcaaagacaatgccttcatgcatgttcagtgtctgcccccgtggctttgaaatgatcgctgacaatgggggatctgcagtgacttctctgcctctgccaaagcccaggggtgctgctccctaattctaaggattctaatgagactcagagcaggtgtaacacagggcatggagcttcctgagcaagaggctggctaacaaactgtggacgtggtacttagacacattaagagacattacagggacacctgcaagtatgtctccctggggagaagccaagtgcagatgctatggccacagatgatatggtttggctctgtgtccccactcaaatctcatctcaagttgt

SEQ ID NO: 18411 - DNA, 369 bp, Homo sapiens
tttttttccggcccgcagcgcgcctgggctcccgcgtgtttaaaagtgcgcttgtggctgctgctgtcttaactcctgtgcttrggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaaraggaatcaacggatcctggcagctgaaacagataggctctcctatgtgggaaacaattttgggactggagccctcaaatgcaacactttgtgcaggcactttgtg

SEQ ID NO: 18412 - DNA, 408 bp, Homo sapiens
agaargstgggarggstgcgsggggctgcgcgtccgccatggagccgacggacttacgagccgggcttcgtgggtattcgcttctgccaggaatgtaacaacatgctgtaccccaaggaagacaaggagaaccgcattctgctctacgcgtgccggaactgkgataccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgagcgttcagctggtactggggaggtgcggccacaaggaggctgtgttcttccagtcacacagtgcgcgggccgaggacgccatgcgcctttactacgtgtgcacagc

SEQ ID NO: 18413 - DNA, 389 bp, Homo sapiens
tttcgcttctgccaggaatggtgaggcggagggagcgggtgatgttagaaggcgggcgaggaatggctccagaactaacccctggcacctccccctccccacagtaacaacatgctgtaccccaaggaagacaaggagaaccgcattctgctctacgcgtgccggaactgtgattaccagcaggaggccgacaacagctgcatctatgtcaacaagatcacgcacgaakkgacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcaca

SEQ ID NO: 18414 - DNA, 340 bp, Homo sapiens
ctttttcccccacactcgccctctcgtagtgccggaactgtgattaccagcaggaggccgacaacagctgcatctatgtcaacaagatcacgcacgaakacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtcaaaaa

SEQ ID NO: 18415 - DNA, 367 bp, Homo sapiens
ctcataaatactgataggaacacaatgatacttttttttcaccctttttatatgaacagtttgaagcataaagaaaagttgaggctgggcgcggtggctcatgcctgtaatctcaacactttgggaggctgaggcgggcgtgttgcttgagctcacgagttcgagatcaccctgggcaacatagtgaaaccccacctctaaaaaatacaaaaaattagcctgtagtctcagctactcaggagcctgaggtgggaggatcacttgagcctcggaagcggggttgcagtgagccgagatcacgccactgcactccagcctgggcaacagagtgagatcctgtctcaaaaaaaaaaaaaaaaaaggaaaa

SEQ ID NO: 18416 - DNA, 377 bp, Homo sapiens
agtcatagacgagtagaccttaggcgaaggaaggcatgtactttccctaagaagcgggaggagagaaataaatagagggcagtgggatgagaagaacctcgcgggatgggaagccgcgtagggaagggccgtctttggttacctggagagcgggacagctgcggatcccttatgaagtgcccggatgaagctccagcgctcacgcctttccgcattgagtgcagcgccatcttgagaagggcggasgtcttgtttggaatgacgtctgttcagagagccaatcccagtctcgcgactcctgcttgctgggcgcggcttgggcctccaggctgcgcascagccgctatcaggcggactgcagttcttgccgagcaggt

SEQ ID NO: 18417 - DNA, 522 bp, Homo sapiens
gaggataaggcgctgtcatggaggacgccgccgcgccggggcggaccgagggggtccttgaaaggcaaggagcgccggcagctgcaggccagggaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttg

SEQ ID NO: 18418 - DNA, 483 bp, Homo sapiens
agtagcatggcgtcaagatacaccccaggcctgctaattcagaatctgcattttaacaagatccccagggattcacatgcaccttagagtgtgacaagccctgatttagaagatactatttgcagagcctgaagtacgtgaggtatggaaagagagacgacagaaaaagaaatcaccaagtttcagccttctgataaataaatacattgattaataatatggtacacaaagggatggagatgggaagttaaataatgacccaaggcagtgtgatatacaacacatgagtgtgcagtcccaattccttgtgacacagagcaccagagaagaataaattccagtgagtcggattagtttgtctttgatccattcagaaatgttaaattaatgttcttgacattatgaaataaaacaacacatctcaagtgcttacaatgatgtttagcacatggtgtgcagacaaccaactttaaaaaaaaaaar

SEQ ID NO: 18419 - DNA, 547 bp, Homo sapiens
tagaaaaatggctatttattttaaccttttttaatgttgctggtcataagtttatgttgctacttctttttaaatgaacaagaacagaaagggcacaaactttagttttggaaaatgtaggtattgtagctaaaaatgacatccctctgttccaatgctggaaaaagtgacatttctccttttctgagacctagcccaatttattgcttgtgttaatcaccctctggtattgtacaccagtggctggccttggatctgtattctccctgttggagataagaaatatctgctgtcatgaaaaaaccttttatcgtagaagagcggtatagctaatctgctttgtaatagagtagtgtacgctcttatccacggtttcactttgtgtggtttcagttgacctgtggttaactgcagtcagaaaatattaaatggaaagttccagaaactcctaagttttagattgcacccttttccgagtagcatgatgaaatctcgcactgtcctgcctaggaggtgaattatccctttgtcagcttatctacactgt

SEQ ID NO: 18420 - DNA, 97 bp, Homo sapiens
cccttctccccggcggttmgtgctgagagtgcggagtgtgtgctccgggctcggaacacacatttattattaaaaaatccaaaaaaaaaaaaaaaaa

SEQ ID NO: 18421 - DNA, 228 bp, Homo sapiens
aaaaaacgaaggcctttccggggacctgggtagtcggttgtaatggcgtttgcctgggatgcagcacctttggtgggccattagatgacgtgtcgcttctccaggggcttgctaggcactagcagaaatgctcccctgtgcttactcggtgttatggaagattgcttgcacaatgctattcgtacgaaaggatattattaaaagtgatttatgggcgggcgcggtggc

SEQ ID NO: 18422 - DNA, 102 bp, Homo sapiens
cttttccttcctctttccttacttccttcccttccctcggcttcccgctcttgcctcactctcagcggctgccttcgcccctgtctgcagacagcgccgctg

SEQ ID NO: 18423 - DNA, 476 bp, Homo sapiens
agtagctgcctgggcgccaaakgccgcggcactcccacgcggaccccgaagtccgcaacccggggatsggcccgcggctgcgagtctgtggattctagccttgggggtctttcacgatccagcactgtggccagcctcgacacagattccaccaaaagctcaggacaaagcaacaataattmagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggagaagaatttattatgggagtttccaagtatggcataaaagtatcaacatcagatcaatatgatgttttgcacaggcatgstctctacttaataatccggatsgtgtgttacgatgacggtctsggggcgggaaaagcttactgg

SEQ ID NO: 18424 - DNA, 412 bp, Homo sapiens
cacggttagttcccaaataaatcccagcctcctctcttctgttaatttcttcggaaggatttgaggtagcttttgaagtatttggtcaaagttgcaaactcctcgggaggaggccaggcatggtacctcacgccttaatcccagcattttgggaggctgaggcgggaggatcacctgaggtcaggaggtcaagaccagcctggtcaacatggcgaaaccctgtctctattaaaaatataaaaatgagctgagtatggtgatgcacgcctgtaatcctagctacttgggaggcttgaggcaggagaatcacttgaacccagaaggcagaggttgccgtgagatgagattgtgccactgcactccagcctgtgtgacaaaacaagactcctcctggaaaaaaaaaaaaaaaaag

SEQ ID NO: 18425 - DNA, 478 bp, Homo sapiens
  misc_feature 11,40: n=a, g, c or t
gctggagcggngaacgggagtagctgcctgggcgccaaangccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggagaagaatttattatgggagtttccaagtatggcataaaagtatcaacatcagatcaatatgatgttttgcacaggcatgctctctacttaataatcggat

SEQ ID NO: 18426 - DNA, 143 bp, Homo sapiens
ttcctgcctcagccttctgctgctttgctctctgggagatccagctccttgctctgtgtcccagtagaacatgatgtggcccatgcacaccccactgctgctgctgactgccttgatggtggccgtggcgggagtgcctcggc

SEQ ID NO: 18427 - DNA, 64 bp, Homo sapiens
atgtgaccggaagggctcctcacggacgccgtcctcctcggcgcggcctgagcgccggsccgac

SEQ ID NO: 18428 - DNA, 186 bp, Homo sapiens
  misc_feature 113: n=a, g, c or t
attctgtctggcaagcgccgcgcgawtcctcggttcccgccgcgccgttgccgccgctcctctccctcctcacctccccgcaagctgagggagccggctctggccttggcsancccagamaggggctcccacagtgcagcggtgagctgaagggttcctcaagcgcggccasagtgggcgccaagg

SEQ ID NO: 18429 - DNA, 509 bp, Homo sapiens
agataagagaataaaagcaggctgcctgacctagcagtggcaaccgttggggtctccttctgcattgtgggagcgttgttctctcactctgcagtaaatcttgctgctgctcattctttgggtccacactgcctttatgagctggaacactcactgcgaaggtctgcagtttcactcctgaagccaccgagaccacaaacccaccgggagaaaggaacaactccagacgcgccgtcttaagagttgtaacacacactgggaaggtgtgcagcttcactcctgagccggggagaccacgaacccaccagaaggaagaaactccgaacacatccgaacttcagaaggaacaaactctggacacgccgtctttaagaactgtaacactcaccgcaaggtcgtggcttcactcttgaagtcagaccaagaaccaaccaattccagacacagagatatgtttgccatacaaattattgttctgccgggtaaatgaagttgcatgtatctttcaa

SEQ ID NO: 18430 - DNA, 427 bp, Homo sapiens
  misc_feature 36,48,101,108: n=a, g, c or t
aacaaaagtgctgcagccgcttgctccggccggcancctagtccggcncgccgcsagctgtcgccgacatggaacccttggccagcaasatcyaggtcctnstgcagnsggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgccctacaccacgctgagcctgctgcgccgtgccaggatgcacatccagaagctggaggatcaggagcagcgggcccgacagctcaagg

SEQ ID NO: 18431 - DNA, 93 bp, Homo sapiens
  misc_feature 63..64,83: n=a, g, c or t
cctttgcaggacgtcactgaggactgcaggggcctgagccgctgctgccgccgccgccgcyannccacatcaacgcaccggkntcccgtaacc

SEQ ID NO: 18432 - DNA, 115 bp, Homo sapiens
cgagtgtattataaaatcgtgggggagatgcccggcctgggatgctgtttggagacggaataaatgttttctcattcaaaaaaaaaaaaaaaaaaaaaaaaaaaaaaaaaaaaaw

SEQ ID NO: 18433 - DNA, 134 bp, Homo sapiens
cgagtgtattataaaatcgtgggggagatgcccggcctgggatgctgtttggagacggaataaatgttttctcattcaaaaaaaaaaaaaaaaaaaaaaaaaaaaaaaaaaaaaaaaaaaaaaaaaaaaaaaah

SEQ ID NO: 18434 - DNA, 137 bp, Homo sapiens
cgagtgtattataaaatcgtgggggagatgcccggcctgggatgctgtttggagacggaataaatgttttctcattcaaaaaaaaaaaaaaaaaaaaaaaaaaaaaaaaaaaaaaaaaaaaaaaaaaaaaaaaaaaa

SEQ ID NO: 18435 - DNA, 55 bp, Homo sapiens
actcgctgggtcgctcgggtcggcttcggtcgctaccgctcccactctgccaccc

SEQ ID NO: 18436 - DNA, 358 bp, Homo sapiens
  misc_feature 324,355: n=a, g, c or t
atttgtctcgttctttcctcccagcaacttcgcggtgtggtgaactctctgaggaaaaacgtaagttcgagccctgattcctccgcttccccgcagtgaccttgggcttgtgccccggmcacccctgtcccgggtccctgttttctctctggaaatgggttgaagaccaaagaaaataatgtgcgccacttgggtcaccgggggccgcctgccccggaaaattggccccagttgaggagttgtggctgtaaggatgccttgaaccgaggcggcggtgctcgtggttggagctctccagggtgggtgcgcatttgtaatgcggtngatgctctgggactcggcccctctaaaggtnctt

SEQ ID NO: 18437 - DNA, 414 bp, Homo sapiens
gtctcgttctttcctcccagcaacttckmggtgtggtgaactctctgaagaaaaaccattttgattattactctcagacgtgcgtggcaacaagtgactgagacctagaaatccaagcgttggaggtcctgaggccagcctaagtcgcttcaaaatggaacgaaggcgtttgcggggttccattcagagccgatacatcagcatgagtgtgtggacaagcccacggagacttgtggagctggcagggcagagctgctgaaggwttaggccctggccattgccgccctggagttgctgcccagggagctcttcccgccactcttcatggcagcctttgacgggagacacagccagaccctgaaggcaatggtgcaggcctggcccttcacctgactccctctgggartgctgatg

SEQ ID NO: 18438 - DNA, 61 bp, Homo sapiens
  misc_feature 12: n=a, g, c or t
accccgcgcgcntctctgtcgtggcgcggcttcccgggtcttctctgcaaatgggctccgt

SEQ ID NO: 18439 - DNA, 478 bp, Homo sapiens
atgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaattttggattgtatcaagtggcatgtgctgtgaccatttataatgttagtagaaattttacaataggtgcttattctcaaagcag

SEQ ID NO: 18440 - DNA, 302 bp, Homo sapiens
aaaggaaattagtgaccactcaaaagtggaattcgtaggagccatcatttcattagaacatcagaatccatcccaggggaccctgccttcaccctttcttcacacacagttgatgaaggggggaaaatgtatctgttggaatttatcatgaaatggatggaaatctcacctgggggcaagttgccactgaaaggaatatacagtcaaatcttgactaactggaatgcttgaatgaagcagatggaaaaggacaaagaaaaaaagacaaaacttcagacattcactttgacattaaaaaagaa

SEQ ID NO: 18441 - DNA, 464 bp, Homo sapiens
agcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacakaggagtgatgatrgacattagtgctccatttttcatggatcctccagccccacttgga

SEQ ID NO: 18442 - DNA, 518 bp, Homo sapiens
aaaactgttctggcgctgatgggagtgtaacaatgaggacaaccagaggtcactgtcatcaccattttggttttggtgggttttggccggctcctttactgcaacctgtttttatcagcaaggtctctatgacctgtattgtgtgctgacctcctatctcatcctgtgacttagaatgccttaaccgtctgggaatgcagcccagtaggtttcagccttattttacccagctcctatttaagatagagttgttctggttcacctgcctctgacactatcaccaggtagacagtgtttgttagaagtgagttaaattgtaggacactcagttgttatccactggagaattgcttggttgtcgacagggggacatccccacacattctggtgaccggagggaagtattctgtgttgagtgttttaactgtgtgagagcaggaaaacactgttttttttgttttgttttgttttgttttccccatccttttcaaagactacattaaacgctaaggagaaag

SEQ ID NO: 18443 - DNA, 377 bp, Homo sapiens
acaacctgttttatctgcaaggtctttgtgacctgtattttgtgccgacctcttagctcatcttgtgacttagaatgccttaacctgctgggaatgcagcccagtaggtctcagcctcattttacccagcccttattcaagatggagcttctctggcttaaacgcgtctggcacatacagagttaaaaaaaagaaaagttgccagatttgtacagatcaggaacttttgcttctcttagaaatttctgacttcgtctgaaaaatcagaacataggccaggtgcggtggcttacgcctgtaatcgcagcactttgggaggccgaggcgggtggatcacgaggtcgggagttcaagacaagcctggctaagatggcgaa

SEQ ID NO: 18444 - DNA, 387 bp, Homo sapiens
atggcatttgtaaactgtcatggtgctggtaggagtatcctttagcatgaaaatacattgtaattattgtgtaatgaccagtgaggatgaacagaggttactttcatcatcaacttggttttgatgagtttgggccaactcctttaccacatgctttattatcagcaaggtctttgtgacctgtgtcttgtgccaacctcctatctcatctgaaaccaacaatcaggcctcccacatagatcaaggaattgaaacttaccagatcacttcatctggacaatgagatactagacaccttacccatcatgagtgcctaagckaccacctgctattgggttaccagctcctcttccatatccctccctaattcctgttttcccacacatg

SEQ ID NO: 18445 - DNA, 275 bp, Homo sapiens
  misc_feature 234: n=a, g, c or t
arttttatcaccatcttggttttkgccagcttctttactgtatcctgttttatcagtggggtccttatgttctatattttgtgtcaacctcctagctcatcctgtgtctaagaatgcccaacatcctgggaatgcagtccagaaggtctcagccttattttacccagcccctgttcaagatggaggtgctctggttggaatgcttctggtagtttggctagttattatcttttnaaaaatttcaaagatgttctcacctggttattctttttttt

SEQ ID NO: 18446 - DNA, 278 bp, Homo sapiens
tttgtcttctgtggtttcagttaaagttctaaagactattttactaaaagtggaattgactttttgtattcaggggaacttgtcagtggttttcatattatgtgccgtggagtcccaggattccagaagatgcctcaagggagacccctcccttcccccgtatcccttccagctttaagcagcctgtctgctttaagctcttatatatattgagattctccatgagatttcatttgtataaatgatttcacagcttacaaaaaaaaaaaaaaaaaggc

SEQ ID NO: 18447 - DNA, 216 bp, Homo sapiens
aaaaaacgccggcgcctccgtccccagccgcggctcgggaatccacccgaagagtggctataaacgtccgcgcctccattgcgctctccttttcacttaggacactggtcctcccacgcctgacaccgacgtcgccaggaccgcggggttgggggaacttggctgtcccacgtctttcaaataaagctgttttgtcaaaaaaaaaaaaaaaaaagt

SEQ ID NO: 18448 - DNA, 396 bp, Homo sapiens
attccacccggcatacaggcttatggagcagccccctttgaagatctccaggtagattccacagagatgccaaagtgtggaggtaacaagtatttacwagttcycawggtgcctaactgggtgggtggaggcttatccaacatgaactgagaaagctcgtgaagtaacccgtgtgcttcttcgagatcttattcctagatttggactgcccttacggatcggctcagataacgggccggcatttgtggctgacttgatacagaagacagcaaaggtattggggatcacatggaaactgcatgccgccwaccagcctcagaattccggaaaggtgragtggatgaatcggactatcaaaaatagtttagggaaagtatgtcaggatacaggattaaa

SEQ ID NO: 18449 - DNA, 425 bp, Homo sapiens
ggggtttctaaattcactgttgagtgctgtggattacttttggaaaggcttttcggagcgcttctgaattttcagattctctaactatccctaacggtgcctggatgtgtgtctgagaaaaggcagcagactcggagaggttgaagggtcgggtcaaagcaaaagatgcgtttgtgaatgtcagacatttggaggctcttcagtggctccttagcatcagggatgccaggcagtcccagtggaagcgaagagatactcggcaagtggctgctggtaatgggacgcaaatgttgacttgatttgtgggacatccacgctgagaactgagtgctcacgtaactcaaatgggggtaatttggtttgttccactatatgtttatcttcaataaaatacctactgtctgtgcaaaaaaaaaaaaaaaaag

SEQ ID NO: 18450 - DNA, 515 bp, Homo sapiens
cctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggcacccgcatagacgggagcggagaggagataagatggcggcccagctgcgcagacaccaggggcggcgaggggcgagctctccccggtgtgtkacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtg

SEQ ID NO: 18451 - DNA, 493 bp, Homo sapiens
cctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggcacccgcatagacgggagcggagaggagataagatggcggcccagctgcgcagacaccaggggcggcgaggggcgagctctccccggtgtgttacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagc

SEQ ID NO: 18452 - DNA, 416 bp, Homo sapiens
cctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggcacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacggtctttagcatgcac

SEQ ID NO: 18453 - DNA, 276 bp, Homo sapiens
agaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgt

SEQ ID NO: 18454 - DNA, 373 bp, Homo sapiens
  misc_feature 160..161: n=a, g, c or t
cctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctatanntcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaad

SEQ ID NO: 18455 - DNA, 406 bp, Homo sapiens
agaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacatgaggaaaggccagactcacagaagggtgttcatttagaagaaagcaacactaatgattcaaacagcttcctgaattttaattttgtgttgtctcacagaaagccttatcataaat

SEQ ID NO: 18456 - DNA, 421 bp, Homo sapiens
agaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacatgaggaaaggccagactcacagaagggtgttcatttagaagaaagcaacactaatgattcaaacagcttcctgaattttaattttgtgttgtctcacagaaagccttatcataaattccataattctaatt

SEQ ID NO: 18457 - DNA, 55 bp, Homo sapiens
cctttccggcggtgacgacctacgcasacgagaacatgsctctcgcaaaggatct

SEQ ID NO: 18458 - DNA, 148 bp, Homo sapiens
ttcttaccatgtctgttttctttgtctcaaatagttccactaatggactatattttttcggttgagaacttgtcgaacagaattttcttttttttttkwaaccttsagtagggaaaaatgtttgtttaaagawtgrgtaatggccagg

SEQ ID NO: 18459 - DNA, 484 bp, Homo sapiens
gaagattaggactgatacttaaaaccaaacgtaaaattccaggtggtgttgctatggggagcagcattaggacaatctgagtggtttcagttgcaagactgtgcgtgtacgtgcaagaactacagtcaaggttcaacttctggcttttagggtctctttaataacagtaataacaacctaaggcagtttaacggtatggaatggttgccttttagaagttaagctatgggcatggaagttcaatcagtacattgaagtttttcctttatctctcctatggttaatggtttctgcagaaaaggacctattgatttctttctaaaacgttgcttcagggtgtagagacctttataggtcatgtttcaacttacagaaaattttatagttcaaatataaattacattcaatgtggactttgtaatagaattgaaggtcaagtaaagtttccacttttcttaggctgtttgcagtgccagcaggcccc

SEQ ID NO: 18460 - DNA, 338 bp, Homo sapiens
cagaaaatttttatagttcaaatataaattaagttcaatgtggaatttgtaatagaatttcaggtgaagtaaaatttccactttccttaggctgtttgcagtgcccagcaggccccatgatatcgagatggaagttctgttaaaggaggagattgatcagggatgggcagaataaggaatatgggcagctcaggcataatgatacaatgattgagatgtagaaagagggccgggcatgggataacgcctgtaatcccactgccttgggaggccaagacaagagaatcgattgaggtcagaccagcctggtcaacagagtgagacctaacctgtacaga

SEQ ID NO: 18461 - DNA, 107 bp, Homo sapiens
ttctttgttaggaaagatctaaatatggtccttgacttttaataatcattctttagaatgttaaataaaggcaacccaattaaagggagaaaaaaaaaaaaaaaaaa

SEQ ID NO: 18462 - DNA, 56 bp, Homo sapiens
cttttgcgttctctttccctctcccaacatggcggcctcagcaaaaaaaaaaaaaa

SEQ ID NO: 18463 - DNA, 462 bp, Homo sapiens
catctaataattggagaaatctggtatgtcacaggctgcagtgtaagcctgtcaagcaatatgatgaagaggtgcacatggggagagctgttttaagtatgtcttttggttccctgggttagaattttttctgctttttcttacctgccttcatccaaagttgggggtcaactgcagatcctgaaaagtggatctcaggaatagtcccccatgtcctgtcactgctgaatctacactaagaatggacaagtgtgttcaaggctggcctgcctttgtaatcagtcctccgtgggctatgcagggatcccactagttacgcactcatctgttgcagcatatcagctgcggctgtactgtagaagaatgcaacgccctagtggcaaatgctgactccaggaatgcggaggaggaggaggactgcatagctcatcactgggggccacttgactggagcagctgtgc

SEQ ID NO: 18464 - DNA, 76 bp, Homo sapiens
ctttttcgcaacgagtttgccgccagaacacaggtgtcgtgaaaactacccctaaaagccaaaaaaaaaaaaaaaa

SEQ ID NO: 18465 - DNA, 414 bp, Homo sapiens
agcccgggagctcgagaccagacgcggcaacatggcgagacgcacatctctgcctttaaaaatgagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcgtcgtcaaggaagtaaatgtagttagaaatctcaaaa

SEQ ID NO: 18466 - DNA, 398 bp, Homo sapiens
  misc_feature 245..246,290: n=a, g, c or t
attatgttttacaaatgtctgtatttagccagttcttgattttcttttgacacagctccaaggccaccagctatgcaaggccacaagttatgcactatatgattaactgcttttgttttacttttggggctggagccctgggccaagggagacctgtgaccccaggtggccgscsggragaacttcagcccagaggggaaatcagctctccgtgacccagcacccctacccagcagcgcaacagnncctgaaggagctacaggatgattctagaaacagcgcacttcavnaatcatgttgcaggtgttgtgcattggatccaccacagtcggctgaaactgacaactcaagacaagtggaccagccagcaggacccagatcatccaactcggctgatc

SEQ ID NO: 18467 - DNA, 427 bp, Homo sapiens
agtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggccagaaggcttagcgggattgcacgaggttagttgctaagcaaggtggtctttggtcaactgccgcctggaccaaggcaacaggaaccctcagattcatcgctaccccgaggctaagcgc

SEQ ID NO: 18468 - DNA, 440 bp, Homo sapiens
  misc_feature 48: n=a, g, c or t
ctcttgccccattgctctttgcaggggtagaagaaggaagtgtagcgnggtaaggaatgcaccgtcaggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcg

SEQ ID NO: 18469 - DNA, 439 bp, Homo sapiens
taatctcattttacctcagctttactatatgttaggtagacaaaataatagtttctacgtcacaaggttattttgagaattaaatgagttaatatgcataaaacactcagatcactgccaggcacataagatgtgggtcgagcgcagagctcatacctgttatcccagtgctttgggaggctgaagtgggaggattgctagaggctgggaatacacaactagcctgggcaacataaagagaccttgtctctacaaaaatttttaaaaaaattagctgagcatggtggcgcgtgcctgtagtcccagctactcaggaagctgcagagggagcaccatttgagcccaggagtttgatgctgcagtgagctatgattgtgtcactacactccagtctgggtgacagagctagatcttgtctctattaaaaaaaaaaaaaaaa

SEQ ID NO: 18470 - DNA, 412 bp, Homo sapiens
tcaataaggtaattgtagtgagcttggactcttgtcccttgcacttgctttatgaccttgaataaattactacttcttgctctacctcagttttcacatatgaacaatgagattaatagtaatatctatttaagtagggatgtgagaattaaatgagttaatacatgtgaagcacttagcccagtgcctggcagatagaaactctatataaggttaaaggtaataatggtggtagtagtagcagtagttatatgaggatttaaatttcttctttcatgccaggcatggtggctcacgcctattatcccagcactttgggatgccaaggcaggcagatcacttgaggctgggagttcarcaccaacctgcccaacctggaaaaacccgtctctactaaaaatacaaaaattgg

SEQ ID NO: 18471 - DNA, 410 bp, Homo sapiens
tcaaacaaatggaagggaaaatttggggaggcagcagccaggtactgccaggtaattggagataggccttccagataccagcgaccagtgaagttgaaatctcccgtaggggttggatagaatggagcagcagttaggccccctagtgtctgctcagccacctggggcagcagaatgttgtcaaacttcttcattccataccacaatcaaatggagggacccaactctgaaaagatggtaagaggaagtgatctgaattggaggaggaggatttagattagcttttgaggaaacttcctcatgcctgtgaggttcttcagggggcgactgaaggagatcagagctctcaaaggatggggcagaaaaattcaatttcagcttgaggaagaagcctatgatcagaatcagag

SEQ ID NO: 18472 - DNA, 440 bp, Homo sapiens
agttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgcagcctcctgctcgcaccgctgcagccgggcgccggagtaatatgctcactcgagtgaaatctgccgtggccaatttcatgggcggcatcatggctggcagctcargctccgagcacggcggcggcagctgcgg

SEQ ID NO: 18473 - DNA, 417 bp, Homo sapiens
acagaccccctcacagcccagcgcagtgcaggcccttggagagcaggagttagagatggggaggacgtgctgcaacaggcactgccctgctacaccctgcccatgggcagaggggatgtcctcccamcccacagaggccccatccttcccttttctctccctaaggctgctccagcagggagtttagctcccatggacacctttgaagactgtgaaggcgcagaagacatggaaaaggagagcagtgctctgagtctcgcgggccttttccagtcggacgacagtcacgaaacctgttcctccaaatctgctttcctggagargggagaaagcagccagggagaaaaagaagaacgcgatgaggaggaaacggcgacccgcagcaccgaggaggagcgcgctggggcgtccacgggc

SEQ ID NO: 18474 - DNA, 426 bp, Homo sapiens
ctctgttctttttcaagattgttttggctgttaagggtcccctgcgattccatgtggatttcagaattgatttttctatttctgtagaaaacatggggatattaatagggtttgtatgtattgaatctgtagatggctttgggtagtgctgatatcttaatatcggatcttctgatccacaaacacagatgtctttccatttatttgtgtgtttaatttcctttgatatgtaccagtcatttgtctccttggtttcttacgtattatttttttgatgttactgtaaatggaattgctttaataatttccttttcagattgtccattgttgatttatagaaacacaactgatttatctgtgttgatttttgtatactgcaacattgccgaatctgttagctctaagagtttttttttttttttcctg

SEQ ID NO: 18475 - DNA, 498 bp, Homo sapiens
  misc_feature 2: n=a, g, c or t
angctcgcaagtgcgcgtagccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgarccgtcgccgccgtcgtcccccgcccccagtcagcaaaccgccgccgcgggcgcgcccccgctctgcgctgtctctccgatggcgtccgcctcargggccatggcgaacacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatc

SEQ ID NO: 18476 - DNA, 324 bp, Homo sapiens
tgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattaaaaaaaaaaaa

SEQ ID NO: 18477 - DNA, 237 bp, Homo sapiens
tttaattatttgttcatcagttgatggacattttggtgttttcacttttggctatttttgagtaatactgctgtgaacattcatgtacaagttttttgtgtggacataggtttttatgtttataaaacatgttttatgtttatgtytttatgttttatgtttatatttctcttgggtacattccacctagaagtggcactgctgggtcatatggtaacttttwttttttttttgaaa

SEQ ID NO: 18478 - DNA, 478 bp, Homo sapiens
ctaagctcgttcttccgccagcttccctcctcttcctttctcagccatcgtggtgtgttcttgtabtccgctgctcgccatgtcttctcacaagactttycaggattaaagcggattcctggccaagraaccaaaagcaaaaatcgtcccattcccccagtggattcggaatgaaaaactggaaataaaaatcagggtacaaactccaaaaggagacattggagaagawaccaagctkggkccataaaggratttgcacatgagatggcacacatatttatgctgtctgaaggtcacgatcatgttaaccatatcaagctgaaaatgttcacccactatctggagattttcgacgtgtttttcctctctgaatcttgtttatgaacacggttggttggctggattcagtaataaaatatgtaaggcctttctttttaaaaaaaaaaaaaaaaagstcttwtcgataccgtcgacctcg

SEQ ID NO: 18479 - DNA, 303 bp, Homo sapiens
actctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagcaagaagtttgaccgagtgtctcgactgcattgtgagagtgaatctttcaagatggatctaatcttagatgtaaacattcaaatttaccctgtagacttgggtgacaagtttcggtt

SEQ ID NO: 18480 - DNA, 311 bp, Homo sapiens
actctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagcaagaagtttgaccgagtgtctcgactgcattgtgagagtgaatctttcaagatggatctaatcttagatgtaaacattcaaatttaccctgtagacttgggtgacaagtttcggttggtcatag

SEQ ID NO: 18481 - DNA, 326 bp, Homo sapiens
gccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccgggaggcaagaaagtttgaccgggaktgtcycgactgcattgtgagagtgaatctttcaagatggatctaatcttagatgtaaacattcaaatttaccctgtagacttgggtgacaagtttcggttggtcatagctagtac

SEQ ID NO: 18482 - DNA, 437 bp, Homo sapiens
aagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacct

SEQ ID NO: 18483 - DNA, 353 bp, Homo sapiens
taggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttcttttttttttgtgggggtgggatgggggaggttagttacacttaaaatatcttctccagagactgtatgctcctatactagactgtaagctctttgagggcagtctgtcagatttatcttkgtatcttccccagcgcctagtgtagtgccttgc

SEQ ID NO: 18484 - DNA, 102 bp, Homo sapiens
taagcttccttctaacaagggtagtagacgtacgtgtctgtgtcttctgttctctaggtrtkgattstgsaatgctgcacagaaacctactgcarcctcaga

SEQ ID NO: 18485 - DNA, 472 bp, Homo sapiens
agttggtcttgaggctgaggaagaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtaaggtatcaacactgttagtagcaacaaaattttaacttaataagtctgtatttgctatttataaagtggcatttgtaaagaaactgatagtagaatgtagtattcgtattcatttgaaatacattcagccatttgtatcagcagtctctatagcagcagattctgcatctgtggattcaaccagctgcagattggaaatatttgggggacaaacaataaataataatctgacaataaaaaataataa

SEQ ID NO: 18486 - DNA, 577 bp, Homo sapiens
tagcatgtcccaagtaggggctgcccctttagtctaggaaccaggatgataagacacatggagcagagccacagaagctcacatgtaaccacaacggtcccacgtaatgttagagaaacaaatgctcttgtaacactgagattcttggtggtattattgcattaaagttgactaatgtacctcccaccaaccgtaagagataggaattgttattatcctgtgatattgtgaaatacatagttgatcttctccccgtttcctgacatacaacttctaaaatccttagaatctccaaagtgatgtctttttatatgctgatgagttgactgatgcctggcagcccctgggtagcttcaggatggggctggtcactggaaagaccacagcaggattagaaggatggcaatttcagctccaccccatcaacatctggggaggagggcaactgaaggtgaagtggatcaccaatggctgatggattaatcaatcatgcctgtgttacaaagtctccataaaagctcccaaaggactgggttcagagagcttctggatactgaacacatggatgttactggag

SEQ ID NO: 18487 - DNA, 493 bp, Homo sapiens
acatttttcacatcctgttattctgggttttgtgacttgctgccttgccactatgaagacgtttgatgcaaatgatttgtatcaggggcagaattttaacaaggtcctcagttccttagtgactctaaataaagtaacagcaggtaagactcttttttattgaactcgagggggtgggaagacatactggctgacacctttggttttcttgttttaccaaagccaggggagcattactgaatttaaaaaataagcttttgttgcattacgttttgattgttccttttgctgtgatattttatttgccttgttagaatagaatcttctttaaatgttctggtatatatcaggtgttttcctttctgtgggtggagagatttctcacctgaacgtatagcaggagaaaagtgtctagttcttatgggaaggctcatgggctgtgttggagctagaagcacctttctctcagtttttactgagtgtatgctggtta

SEQ ID NO: 18488 - DNA, 319 bp, Homo sapiens
caatcaattaacatgttttgtctggtagatatatactgtattcttacaataaagtaagttagaggaaagaaaaaggaaaatcataagggagagaaaataaatttactactcattaaatggaagtagatcataataaaattccttcatcctcatcattttcacattgagtaggctgaggaggtggaggaaaagtagaggttggtttttgttgcaggaagtcagggaccccgaacggagggaccggccgaagccatggcagaagaacgtggattgtgaagatttcatgaacatttattagttccccaaattaatactttta

SEQ ID NO: 18489 - DNA, 435 bp, Homo sapiens
aaagccgagggagccggctccggcctccgccagctcagagaagggctcccacagcgcvstcgggctgaagggctcctcaagcacggccagaatgggcgcctggacgaggccggggaggcaccgagaacgagtgagggctgcgagggctgccaggtccgccagcacgctgtcacctctcagtttgagaaccatgaactgaagttgttgcaggaagtcagggatcccgaatggagggaccggctgaagccctggcagaagaacataaattgtgaagatttcatggacatttatcagtttccaaaattaatacttttataatttcttatgcctgtctttactgcaatcttggaacataaattctttctggaacaatgtcaaaagtcattcatttggggggaactcattctctacaagcaaactacaaagcctttgcgt

SEQ ID NO: 18490 - DNA, 405 bp, Homo sapiens
tttttttatgattttggaactcttataagtcctgcatttcataagcaagaaatagtgtttctccaagcttgttgccttgtgtaagtatttgaaaagaatattgaggccggtcgcggtggctcacgcctgtaatcccagctctttgggaggccaaggcaggcagatcacctgaggtcaggagtttgagaccaccttgaccaacatggagaaaccctgtctctactaaaaatacaaaaaattagccaggtgtggtggcacatgcctgtaatcccagctactcaggaggctgaggcaggagaatcacttgaacctggaggcagaggttgcagtgagccgagatcatgccattgcactccagcctgagcaacaagagtgaaaaactccatctcaaaaaaaaaaaaaaaa

SEQ ID NO: 18491 - DNA, 680 bp, Homo sapiens
ttaatctacatcattgtagatactgttgcattttttctaatgatatcttaaggataaattttggagtgtgttattatgttaaggggtatcagtgtttttatggctcctcacatatattgtcctactgttttcaagggtgttataccagtttgtgctcctaacagatatatggatatacctgttttaccataagtagtagagaaaaccatttttcttcagaagtttttgtgaatttaatagtgtaaaatggcactttcatttctttgttatataatgttgaatttaactatttgagcctctttatggtgaactgtttgttgatatcagttgctatattatgcaattaactattgtaggctttgaatggtaaggctggtataatatggtcagtaaaaattgttcacaagagtgtgtggtcgaggctgggtgcagtggctcacgcctgtggtcccagcactttgggaggccgaggcgggcggatcgggaggtcgggagatcgagaccatcctggctaacacgatgaagccccgtctcttctaaaaatgcaaaaaattagccgggcgtggtggcgggtgctgtggtcccagctgctcgggagtctgaggcaggagaatgggtgtgggccccgggargtggagcttgcagtgagcctagatagagatagcaccactgcgtacagc

SEQ ID NO: 18492 - DNA, 553 bp, Homo sapiens
aattaaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttggggctgacaagatgctcagcgagccctcacgtttctttcgcttttttacctgccaatcaaactgctacaagacaacaccctgatctggcatggacatatccaacttagaaataatgtttcattcaagataaggctcgtggcttaggagattgtgacctggcttgcatcattctaagacttctatcgtctgttttcaaaacccaaggaggaccctccttttctgtgtgatagttcctcatgctttgccagccactgggtctttaaggaagcttgccaagagttcccggctgggaaggacagttcgagttcatcataggacaatgagctggcaccacag

SEQ ID NO: 18493 - DNA, 460 bp, Homo sapiens
  misc_feature 19: n=a, g, c or t
cacacacacaaaatcgttntttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgt

SEQ ID NO: 18494 - DNA, 407 bp, Homo sapiens
  misc_feature 238: n=a, g, c or t
aagaaacccaatgatcctgcagcagcccttgcagcgaggcccccagggaggggccagcgcctcccgcgggccgccttgggggtgacttggggcctggacgccagctcccctctccgaggagctgtgcccatgagcaccaagcggcgcctggaggaggagcaggagcctctgcgcaacratttctgtctgaggagaacatggccacccacttctctcaactcagcctgcacaatgaccncccctactgcagsccccccatgaccttctccccagccctgcccccactcaggagcccttgctctgagctgcttctctggcgctatcctggcagcctcatccctgaggccctccgtctgctgaggctgggggacacccccatgttccccctaccctgcaaccccagctgg

SEQ ID NO: 18495 - DNA, 447 bp, Homo sapiens
  misc_feature 199: n=a, g, c or t
agatcccacccgcagaccccaaaacccaatgatcctgcagcagcccttgcagcgaggcccccagggaggggcccagcgcctcccgcgggccgccttgggggtgacttggggcctggacgccagggagcctctgcgcaagatttctgtctgaggagaacatggccacccacttctctcaactcagcctgcacaatgacsncccctactgcagcscccccatgaccttctccccagccctgccccmactcaggagcccttgctctgagctgcttctctggcgctatcctggcagcctcatccctgaggccctccgtctgctgaggctgggggacaccccagtcccccctaccctgcaaccccagctggggacataatggagctctagtgctggtggacagtgcccctcccacyttccttcttccccacaacagaagagaccagcgactc

SEQ ID NO: 18496 - DNA, 465 bp, Homo sapiens
aatgatcctgcagcagcccttgcagcgaggcccccagggaggggccagcgcctcccgcgggccgccttgggggtgacttggggcctggacgccaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgaccaaa

SEQ ID NO: 18497 - DNA, 469 bp, Homo sapiens
agaattgtgagaaaatgaattggttcagccactcagtctgtggtacttcgtcaaggcagccctagcaaaactcttccaccttctaatgacttttagtcatctctggaataaaacccacaggctctaagaagtttctaaggcctaggatgatctgactgactcttgcctctggtgcctcagccttaaacacttcctgcctctctctactccagccacactagcctcggtgcagttccacatacatcatcctccttcgtctggagcctctggatgtcctgtttctttggcttggaatcctcctacctgctcatgctacttactcacctcgtcagtagcaccacccttcaagtctcagcttaaacatcgctccttagagaagccatccttgttcccttagactagggaacaagggaatctgtggtaattctgtggtaatcttccacagaattttgtactggtaatttacagc

SEQ ID NO: 18498 - DNA, 422 bp, Homo sapiens
acgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcasggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaaccaaaaaaaaaaaaaaaa

SEQ ID NO: 18499 - DNA, 195 bp, Homo sapiens
ctaagctcgttcttccgccagcttccctcctcttcctttctcagccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactcc

SEQ ID NO: 18500 - DNA, 508 bp, Homo sapiens
acggttgcattcagctggcaggttggctgatggcggggctcagcagagaagctgggatggctggcctgactctcttcacataattttagtctcttcccaccatgtgttctctccagcagggtagccagacttcttacatagttgttcagggctcccacaaatgagcattccaagaggacaaaccccagtatgcaggcatttaccaagcctctgcttgcatcacaactgcgatataccattggccaacatttgtcacattgagggagaaggcaggactcaactccagaggtggggctgaaactctggaccagattgaagactaggtgaacagggaagcagtgaaagcacctctccatgagacatacccagcaacaccatgtcagtttaccacagtgatggcaacacctaaaagttaccacccctttccatggcaatggcctggaagtatcatcctttgtccagaaaattctgaataacctgccccttaatttgcatgtaattaaaaaaa

SEQ ID NO: 18501 - DNA, 476 bp, Homo sapiens
gcagaatctaaaatgcaactttgaagctggatcccttgctggctgcagggaaatgagaagcctgccactggtattagatgtgctgttcttgacgtccttacttctgtcctcagaatcatatcttcgcatctgaaagaaggcaacagcattgagcaacaatctgggactctatttgatatcttcccttgagaagtgttaaatgttgccataatcttgacagttcaaaagttagtcatgtggttgatattttaccaatgagatgaatgtgatgccttctgaaaagttttctgttcaacagagtcataaaatgttagccctagaaggtgccttgaagaccacgatgagttaactttcttcctttgccaaggaagaagcgattacttcagcaactggacttgcttgaatacaaggaacgccatctaatgaaaatcccatgccgcagtgragctggagggagcatcgtgagtggctcagac

SEQ ID NO: 18502 - DNA, 473 bp, Homo sapiens
  misc_feature 394,407: n=a, g, c or t
aagcagaatctaaaatgcaactttgaagctggatcccttgctggctgcagggaaatgagaaccctgccactggtattaggtggggaaatgatagcccctagcatgctatagcagtgcagttgttagaacttttacaagttctgagctggaataggacacgagtggaagatgtgctgttcttgacgtccttacttctgtcctcagaatcatatcttcgcatctgaaagaaggcaacagcattgagcaacaatctgggactctatttgatatcttcccttgagaagtgttaaatgttgccataatcttgacagttcaaaagttagtcatgtggttgatattttaccaatgagatgaatgtgactgtaatatgggcaaatcccacctaccataaaanctggcaatacttncctaatattgaaggaaaggagacatttagagcaagccaggaagctggaacaccggatcaggaacag

SEQ ID NO: 18503 - DNA, 445 bp, Homo sapiens
  misc_feature 197: n=a, g, c or t
catgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaanttagcaattgtgattcctcttgtaaaacaaaacaaaaaaacaatgccatattttttggagaaaagttggcaatataggggtttcgttgtctgtttcacaagaagactcatttgttcttttgggggamccagtgccttacagattttgtatatactgtaattattcaggactagggaacaaacaattgtattgtatttgttacagattgtatatggctttgttttaacattcccctaaataaaatggct

SEQ ID NO: 18504 - DNA, 289 bp, Homo sapiens
matgttcctamagtyawtamawawtymatwagaargttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgc

SEQ ID NO: 18505 - DNA, 554 bp, Homo sapiens
cctttggaattgttaccagggtgaactcaccagccaggggaataccccagaaagagctgccagtaggaggagggccagcctcactgagattggagtccagcagtcccactgattgggagtgctgagccaagcccatgtcgtgcttcgctgatgcatggctgggctgaagaaagagctctttgaatttttcatagaaaagactggtgcccaaaaggccagggctcgagaatgaggctgcctcaagcacagtgcttggcaggacaccagggctgaaaggtacagcaaagtcctcccagaatcgcttgtcagagcagggatttgcatcacagactggccactgcaaagacagatgggaactcacaggttttgtgtgtgtgtttgtggttcactgctgatggacgcatgtcagaagccacctgagccttggcccagccttcatgtggagtgaaaacccagacctgtgtgagcagcaggtacttgaagcaagagaagcaaggccgagcctccagggctttgtcagaggctccttccttcctggaatccaattgtacaac

SEQ ID NO: 18506 - DNA, 446 bp, Homo sapiens
  misc_feature 409: n=a, g, c or t
ggtttgccccaggggcaggttctctgacctcatgctcacgggatgcgacctgtgcagcccctggccttcgctctcttaacgagccgctctggctgacataaaaagcgcgagagggcttttctccatctctggtagggatagagcccctctgcagctkhcgatttgggaaatacctgaggttttttccacttgcacagaaaggctattctagccctgaagctggctagtaagacgctatagtcccagctactccggaggctgaggattaattcctggcaatgaaacaaaagcaaaattatcccattccacagtagattcggatgaaaactggaaataaaatcgggtacaactccaagaggagatattggagaagaaccaagctgggtctgcaaggaactgcatactmadnggcatacgtatttatgctgtctcaaggtcatgaccaa

SEQ ID NO: 18507 - DNA, 563 bp, Homo sapiens
ggaaggagtgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaa

SEQ ID NO: 18508 - DNA, 485 bp, Homo sapiens
ggaaggagtgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggcccctgcac

SEQ ID NO: 18509 - DNA, 505 bp, Homo sapiens
ggaaggagtgcagcggcctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgc

SEQ ID NO: 18510 - DNA, 510 bp, Homo sapiens
ggaaggagtgcagcgctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcatcaccc

SEQ ID NO: 18511 - DNA, 488 bp, Homo sapiens
  misc_feature 17: n=a, g, c or t
ggaaggagtgcagcggnctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgag

SEQ ID NO: 18512 - DNA, 564 bp, Homo sapiens
gccattctcctgcgtcagctcctgagtagctgggactacaagcacccgccatcacgcccggctaattttttgtatttttagtagagacggggtttcaccgtgttagccaggatggtctcgatgtcctgaccttgtgattcgcccgcctcagcctccctgggattacaggcgctttatgaatacagaaacttcgtctgggtcattgattcatccctggaacctataagtgatgccaagaatatagtatcagctcactgactactttttaggatagttggttctcttccttctcagttgtttctcccgacaaaagttcccagcctctagcatcagagcagcctttgctggagtcatagaagccatcactagagaatacaccaaatgtattcaatttgaaggcatcatcacctccctcggccaatcacagcactattcacaatagcaaagacatggactcaacctagctgcccatcaacagtggattggataagaacacgtggattcccagaaagtgttgaatagcagtgatgaaaagcagactgtctcattcctgatgtcaagaga

SEQ ID NO: 18513 - DNA, 450 bp, Homo sapiens
ataaagtatgtgcactcaacagtaaaaaaggaaatatatgaagataatataagccacactgtaattcttaatcatgcttacatttttgaaactgaaacctaaccttaagtcaagtgataggagaatgatgtgtatttactacatttggacacccaggagagtcatgcatgggcagaaaccatagaagctactcaagaggagagcaagtctgaatgttttctccatgccaggtgctgtgctcaaagctttgcatacaatctcatttaatcctcacagcaatctactaccatctccatttcatagtttagaaactgtggcttcaagaggtgaagtgaactgctcaaggtcacataagggtaagtgacagaatttggactcaaacccaggacagatttcaaaacccagattcttataatgtatgctactgtaataagttcattaaaggaatga

SEQ ID NO: 18514 - DNA, 523 bp, Homo sapiens
cattatagttttatgctctgtggtttcgggcctagcctcttacccagcgaggatctgtggatgataatggtgaaggccgtctgctgcagggctgccgtctcggctgcacgactcttgaccccgctgcgtgtgtcttctcagctggaactcaccattgtgtaaatttgcctcactctgctttcctagttcttctgtcttctcttcttagagacagtccttctttcttctacctgtgaaatacctatttatctctcaaaacccagctcaaaagttttctcagtcaccttggaatggtagcatctcccycttgaaataatggcacattggactgtttatgtgacactgctttatgctttagatgtccgtgtgaacgtccctctattgtagcagagatggctctatccagttttgtgtcctcagagcttattatgacaccttatcagtatacttacatcttagttacacttcccattgctccgaaaaggacttggggctgctcacacaatacgtgaaataaaataag

SEQ ID NO: 18515 - DNA, 190 bp, Homo sapiens
ctttttttttcgcgtctgcggtgcycggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttccaaaaaaaaaaaaaaaa

SEQ ID NO: 18516 - DNA, 541 bp, Homo sapiens
ctttttttttcgcgtctgcggtgcycggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaaggctgaggcaggagaattgcccgaacccgggcggcggaggtt

SEQ ID NO: 18517 - DNA, 387 bp, Homo sapiens
ctttttttttcgcgtctgcggtgcycggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaagaaataaatct

SEQ ID NO: 18518 - DNA, 513 bp, Homo sapiens
ctttttttttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgatagcatcagctctaaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgtttttggggagtgctgcttcctctg

SEQ ID NO: 18519 - DNA, 416 bp, Homo sapiens
ctttttttttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacctgcataaagaaaataaaatcttttaaatcaaaaaaaaaaaaaaaaagg

SEQ ID NO: 18520 - DNA, 487 bp, Homo sapiens
  misc_feature 82,421..422: n=a, g, c or t
ctttcgcgtctgcggtgctcggagtgtggtacttctcctagttgcagtcaggcttcatacgctattgtcctgcccgttagancagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccnnaaggttactgtatacatagcctgagtttaaaaggctgtgccgcttcaagaatgtcattgttagac

SEQ ID NO: 18521 - DNA, 471 bp, Homo sapiens
cttttcgcgtctgsgtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaaggctgtgccacttcaa

SEQ ID NO: 18522 - DNA, 481 bp, Homo sapiens
  misc_feature 141: n=a, g, c or t
ctttcgcgtctgsgtgctcggagtgtggtacttctcctagttgcagtcaggcttcatacgctattgtcctgcccgttagagcagccagcgggtacagaatggattttggaagagggagtcactactggacstccaaggaanccacgtgcagasatstasaaccttcgatctcctgacgagtttattgttggccaaaascaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgt

SEQ ID NO: 18523 - DNA, 481 bp, Homo sapiens
acttttttcgcgtctgsgtgctcggagtgtggtacttctcctagttgcagtcaggcttcatacgctgttgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcat

SEQ ID NO: 18524 - DNA, 508 bp, Homo sapiens
cttttttttttcgcgtctgsgtgcccggagtgtggtacttctcctagttgcagtcaggcttcatacgctattgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaatttctaactg

SEQ ID NO: 18525 - DNA, 495 bp, Homo sapiens
ctttcgcgtctgcggtgctcggtgtggtacttctgctggttgcagtcaggcttcatacgctattgtcctgcccgttagagcagccagcgggtacagaatggattttggaagagggagtcaccactggacctccagggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacataggcctgagtttaaaaggctgtgccacttcaagaatgtcattgttagactttgaaatt

SEQ ID NO: 18526 - DNA, 507 bp, Homo sapiens
ctttttcgcgtctgsggtgctcggagtgtggtacttctcctagttgcagtcaggcttcatacgctattgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttttctaactg

SEQ ID NO: 18527 - DNA, 482 bp, Homo sapiens
ctttctttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataawattggttgggagccacgtgtactagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcat

SEQ ID NO: 18528 - DNA, 450 bp, Homo sapiens
  misc_feature 437: n=a, g, c or t
ctttcgcgtctgsgtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacntagcctgagttta

SEQ ID NO: 18529 - DNA, 432 bp, Homo sapiens
  misc_feature 402: n=a, g, c or t
ctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatatattttcataccctaaacaagaagcggtatagaccagaatggagcactgattgtaatccaccttctttcttagaaactggcgatggaatatgagaggagccctctggaaagaaaaggacagaccctgtgctttcatgaaagtgaagatctggctgaaccagttccacaaggttactgtatacatagccndbagtttaaaaggctgtgccacttcaagaa

SEQ ID NO: 18530 - DNA, 393 bp, Homo sapiens
stttcgcgtctgsgtgcccggagtgtggtasttctcctagttgcagtcaggcttcatacgctattgtcstgcscgttagakcagccagcggtacagaatggattttggaagagggagtsascactggacctccaaggaagssacgtgcagacatctasaascttcgatctsstgacgagtttattgttggcsaaaaccaggctttgattgaaccaggatgaatgsgggttttggaagtagaatatatatatacatataaaattggttgggagcsacgtgtaccagtgtgtgttgatcttggcttgattcagtctgscttgtaasagaaactggsgatggaatatgagaggagcystctggaawgaaaaggacagassytgtgctttcatgaaa

SEQ ID NO: 18531 - DNA, 475 bp, Homo sapiens
  misc_feature 61: n=a, g, c or t
ctttcgcgtctgsggtgctcggagtgtggtacttctcctagttgcagtcaggcttcatacntattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgt

SEQ ID NO: 18532 - DNA, 493 bp, Homo sapiens
cttttttttcgcttctgcggtgsccggagtgtggtacttctcctagttgcagtcaggcttsatacgctattgtcstgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgcmtttcatgaaagtgaagatctggctgaaccagttccacaaggttactgtatacatagcctgagtttaaaaggctgtgccacttcaaggatgtcattgttagac

SEQ ID NO: 18533 - DNA, 492 bp, Homo sapiens
cttttttcgcgtctgggtgctcggagtgtggtacttctcctagttgcagtcaggcttcatacgctgttgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataawattggttgggagccacgtgtaccagtgtgtgttgatcttggcttgattcagtctgccttgtaacagaaactggcgatggaatatgagaggagccctctggaaagaaaaggacagaccctgtgctttcatggaaagtgaagatctggctgaaccagttccacaaggttactgtatacatagcctgagtttaaaaggctgtgccacttcaagaatgtcattgttagactt

SEQ ID NO: 18534 - DNA, 465 bp, Homo sapiens
cttctttcgcgtctgsgtgctcggagtgtggtacttctcctagttgcagtcaggcttcatacgctattgtcctgcccgttagagcagccagcggtacagaatggattttggaagagggagtcaccactggacctccaaggaagccacgtgcagacatcacaaccttcgatctcctgacgagtttattgttggccaaaaccaggctttgatttaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccac

SEQ ID NO: 18535 - DNA, 59 bp, Homo sapiens
ctttctccgccatcrtggtgtgtkctkgastccgctgctcgccatgtcttstcacaaga

SEQ ID NO: 18536 - DNA, 485 bp, Homo sapiens
cttttcgcgtctgsgtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttag

SEQ ID NO: 18537 - DNA, 494 bp, Homo sapiens
cttttttcgcgtctgsgtgctcggagtgtggtacttctcctagttgcagtcaggcttcatacgctgttgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttga

SEQ ID NO: 18538 - DNA, 478 bp, Homo sapiens
ctttcgcgtctgsgtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaattgaagatctggctgaaccagttccacaaggttactgtatacatagcctgagtttaaaaggctgtgccacttcaagaagtcattgttagactttgaaatttctaactgcctacctgcataaaga

SEQ ID NO: 18539 - DNA, 460 bp, Homo sapiens
  misc_feature 261: n=a, g, c or t
ctttcgcgtctgcggtgctcggggtgtggtacttctgctggttgcagtcaggcttcatacgctattgtcctgcccgttagagcagccagcggtacagaatggattttggaagagggagtcaccactggacctccagggaagccacgtgcagacatctacaaccttcgatctcctgacgagtttattgttggccaaaaccaggctttgattgaaccaggatgaatgcgggtgttggaagtagaatatatatatacatataanaktggttgggagccacgtgtaccagtgtgtgttgatcttggcttgattcagtctgccttgtaacagaaactggcgatggaatatgagaggagccctcttggaacaaaaggacagaccctgtgctttcatgaaagtgaagatctggctgaaccagttccacaaggttactgtatacatagcctgagtttaaaaggctgtg

SEQ ID NO: 18540 - DNA, 477 bp, Homo sapiens
  misc_feature 262: n=a, g, c or t
actttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataanattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtc

SEQ ID NO: 18541 - DNA, 425 bp, Homo sapiens
ctttcgcgtctgsgtgctcggagtgtggtacttctcctagttgcagtcaggcttcatacgctattgtcctgcccgttagagcagccagcgggtacagaatggattttggaagagggagtcactactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggctkgattcagtctgccttgtaacagaaactggcgatggaatatgagaggagccctctggaaagaaaaggacagaccctgtgctttcatgaaagtgaagatctggctgaaccagttccacaagg

SEQ ID NO: 18542 - DNA, 479 bp, Homo sapiens
ctttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcaat

SEQ ID NO: 18543 - DNA, 475 bp, Homo sapiens
gctttstttcgcgtctgsgtgctcggagtgtggtagcttstcctagttgcagtcaggsttcatacgkstgttgtcctgcccgttagagcagccagcgggtacagaatggattttggaagagggagtcaccactggacctccaaggaagccacgtgcagacatctacaaccttcgatgctcctgacgagtttattgttggccaaaaccaggctttgattgaaccaggatgaatgcgggtgttggaagtagaatatatatatasatataaaattggttgggagccacgtgtascagtgtgtgttgatsttgggcttgattcagtctgccttgtaacagaaactggcgatggaatatgagaggagccctctggaaagaaaaggacagmccctgtgctttcatgaaagtgaagatctggctgaaccagttccacaaggttabtgtatacatagcctgagtttaaaaggctgtgccactt

SEQ ID NO: 18544 - DNA, 416 bp, Homo sapiens
ctttcgcgtctgcggtgctcggagtgtggtacttctcctagttgcagtcaggcttcatacgctattgtcctgcccgttagagcagccagcggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataawattgaaactggcgatggaatatgagaggagccctctggaaagaaaaggacagaccctgtgctttcatgaaagtgargatctggctgaaccagttccacaaggttactgtatacatagcctgaagtttaaaaggctgtgccaacttcaaggaatgt

SEQ ID NO: 18545 - DNA, 472 bp, Homo sapiens
ctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccggcttcaag

SEQ ID NO: 18546 - DNA, 452 bp, Homo sapiens
  misc_feature 263: n=a, g, c or t
ctttttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataanattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagttta

SEQ ID NO: 18547 - DNA, 434 bp, Homo sapiens
agtctcgtatcgcgcccgggaggcscggagcccagcgctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaag

SEQ ID NO: 18548 - DNA, 509 bp, Homo sapiens
gactacggcgcaggcgcggagactattgcgcaggcaagcgcgtacgcagaagcgtgcgcgcgcccgttcaacgtccggagcatcggtgcagtttcgagggtaaagcctttggcgcggtgatgtggacttttgttctctaactacaactcccagcatacgtcacccctcacgtgggcgctaggtgtggtttcgtgggataggktcaccagtgaaaagttgtgcagagcccaacatgagcttcatttccaagctgccacctatctctgcctcctgcgtasatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagttcaaaaaaaaaaaaaaaa

SEQ ID NO: 18549 - DNA, 563 bp, Homo sapiens
agaaggacaggacaatggcggccttagggtccccggcgcacacttttcgaggacttctgcgggttttcagggtcgtaggacgccgttgggcaccacgctcggagaaggacaggacaatggcggccttagggtccccgtcgcacacttttcgaggacttctgcgggagttgcgctacctgagcgcggccaccggcgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtasatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtctaaaaaaaaaaaaaaaaag

SEQ ID NO: 18550 - DNA, 457 bp, Homo sapiens
accacgctcggagaaggacaggacaatggcggccttagggtccccgtcgcacacttttcgaggacttctgcgggagttgcgctacctgagcgcggccaccggsaaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtasatccggaaacatgttgccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaatttttttaagtctaaaa

SEQ ID NO: 18551 - DNA, 462 bp, Homo sapiens
agaaaccaccagctttatagtgtgcttgatagattttaaacattcctgggcaccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccagggagagctcagccaacagagggcactctggggaacctgttagtaaagccaggctggccaaatgccatttgattttgaacctcgtaggtccccactcaccctctgccaggagctaagtaaggcaggagagctgacttgggactcctggctcggcccaacaggagcccct

SEQ ID NO: 18552 - DNA, 472 bp, Homo sapiens
attatcatggctgtaaacacaggttctgcacgtgtctaagttcagccccaaacccacatgaagaacttatttccagacagctcctactcttatggtggctccagaccctgccccatgcagaaggcacttctcaagttccaggaccagggcttcagcacagcactcgcaaaaccccacagatacagtgccaatgacagaaattaagattaactgggggcgacacagatttctgtgaatgccagtgctgtcagatgcttcctgatagtactttctagagtaaaagaacttcgggaaaagtaaaagcagcaaatggtaacaccctcatggagatctcagggtgtagaggcaagcactgaaggcccatgatcagccgtgggagccacgggaatcaattgcttccagtacgactggatgcatcggaaagagcctggggcaaggctggaggcacaagaggagctgccaggccacataa

SEQ ID NO: 18553 - DNA, 350 bp, Homo sapiens
acacgtggctcttgagctcttgagatgtgactagtgcaactgaggcactgagttctaagttttatttcatttttaattcactaaactttaaatagccacacatagctagtggttacaagtgggcagcacaggcctagggtttgactgagggaatatggggcatagagtccaagatctttggaagcaaggaaataagaactgaaagacacgtttttgggaaatgtcatctgagtagggattgatatcatcaagacaggcagggctgctgtagcastgtggtcggaggagttgtggctgtggggactgtgctcgtggcgctcagtgccatgggcttcacctcagtaggaatc

SEQ ID NO: 18554 - DNA, 459 bp, Homo sapiens
aacacatccaagcttaagacggtgaggtcagcttcacattctcaggaactctccttctttggggagcctcagatgggaagggactcgagccccacctgtccctggactctggaatgtctggctgaagttgaggatctcttactctctaggccacggaattaacccgagcaggcatggaggcctctgctctcacctcatcagcagtgaccagtgtggccaaagtggtcagggtggcctctggctctgcgtagttttgcccctggccaggattgctacagttgtgattggaggagttgtggccatggcggctgtgccatggtgctcagtgccatgggcttcactgcggcgggaatcgctcgtcctccatagcagccaagatgatgtccgcggcggccattgccaatgggggtggagttgcctcgggcagccctggctactctgcagtcactgggagcaact

SEQ ID NO: 18555 - DNA, 509 bp, Homo sapiens
agatttaagaagcatctaaaatcaacatgatgccagttcttaggctgatgtgtgtttattaataagaagtaaaattgtccagcatgagccagctttaattaggcattttaaagaagtaagactgtgctacttaatatttgaaaattgatttaatttagaactgattatcaatggtgatttaagtattggtatcccatctttactcctgttgagcaacctgggtggccttatcttccgtgacagtggaatttacaattatttcaaactctgcctttaagtaacttagaatcttctagaagatacaacttataaacagatttaaagaacgatattttttaaagtgattattaaatgattacttatgtagctctagatcatgtaatggtttagaggaggagagaaaagtttcagaactgtgttgcaataagcccctttgatggggcttaacttgaaagggagcccttgtctgatcaaatgacatcagacagaagggagccagtgagtgtgga

SEQ ID NO: 18556 - DNA, 567 bp, Homo sapiens
  misc_feature 467: n=a, g, c or t
atggacctgattggaagcccagggaacttgagttcacagtgtttacaaagtcttcagtagtgtatagcaatatcccaggccttcaaattcactcaccactcctcactgactcacccagagcaacttccagttctgtaaactccattcatgggttccataccgctttatatttcccccggtagattgcatgatgaagaaatactggaaggaaaagtttgatttggctttgcaggaaacacttgacgtcattaccctaccttgaatattaacttcagcaacatgtggctcaaattctagatgttcatcagcttcagtgaggaggatacttaccttgtattatggccaagagaatgacaataacaaaaaagaagaaagtgatgtcaaagattcgatagatctcatattcatctcctgctgggtcttcgatttcatccccgatccctcctccagcacgaactccaacaadnrtgtggaacatatagcactggaaaaaagacatggtatcacttcttggagggacattacccatttttttttctcgacaaacccgagttatctctgtagttt

SEQ ID NO: 18557 - DNA, 467 bp, Homo sapiens
tcatttttctgatgtgaaaatatcctatgttatttactggttataattctaatctcctttgtgtgcattatttattttgattatttactttattatgattgatttgcaaaaattaatatttgttttaacaatgtgcataattatatttcataaaagttttattgttaaaattacatatctaagaaagttgattatctagtctgaaaaagcaggagtatgtcaagttgttaaattaaaatttaaaatgagtaatatattattttatatggataattaggccctttgggacatttactcaaaagtaggtcataattttattatactgtacattctgatatatatatatacacacacacatatacacacatttaagcataaatataaaatagttcatattcctctactaattatgcttttaaaaattatttacattaaattctcattagaaattataaaacgacactagg

SEQ ID NO: 18558 - DNA, 513 bp, Homo sapiens
gccggttcccgctcgcgcctctccctccacacctccctgcaagctgagggagtggactctggccttggcaccccagaaaggggctcccacagtgcagccgtgggctgaagggctcctcaagtgccgccaaagtgggagcccaggcagaggagtcgccgagagcgagcgcgggctgtgaggactgccagcacgctgtcacctctcaataacgcccatcccaacgtttcctgaggaataattttggtcgtgttcctgctactcagcttttcgtggttcctgctcattttcagagtctaacattccagcttttccggaaattctatactttgatgtaaaagttttcaaagaaatgctttgggcagaagagactcatggaaactgagtggtcttgaactcctggcctcaagtaatcctccccactgkgcttccaaagtgctgggactacagagaatcttaacccaaaagaagatgagccaagaacatgaacagacaattcaaagaaaaggaaatgac

SEQ ID NO: 18559 - DNA, 515 bp, Homo sapiens
attttttcttaacagcttatggaacttgaatgcaaactacacatgcagaaatacttaaaatactagcgtgtggaaagatttgagctgcaaactttagacaaaagaaacatggaaatcatattttaaacgggtcatcaaacacctcacaaaacccccggaacttttaaaatacctcttaaagcacttcttgtgttctcttgagggacagtaggtatagtttaccaccttttgaaggaagattaaagtgtgatagttcagggctttactttccattacgcaactgagccccagccttgcagggacggttgagaagtggcaaaatggcggactttctcccccaactgcttgcagtcctgcgacttgctcccaagacagccacacgttttgcttttttgttcgagaaatcggagcagcacgggctgtctgcttgggaaatcttagaaacgtgaaaacccactcttggaaaacgcctcaataccacaccacagagctgctccccgcctgagccccggggg

SEQ ID NO: 18560 - DNA, 511 bp, Homo sapiens
cagtcttgttgagacagacttttcttattctgtggctgtcctgtgggaatttattgtgtctctatacctatatttattctcccttctagtgtcctctgtggttctgggctcacaagagggcacctggcaagggtacagaattgtagagtgagggatacctcaagcaccaactattccaccacctcattttatgaagagacaaagagatctgtgactggtgaccccagagtgagggagccacagagctggcttacaactcttaggcctgggtcctcttcattgcttctgctgctatgtaccctttgatagatgaagagaatgtaatrcagagctgtccattgcaaccctcttgttcaaaacccctcaatacttaccgtaatccaattaaagactttattctttaagcaagccctcacttctggcattcaaattgcttgtaaggattaactgagttaatacagacaaaacatttagaaagttcctgggacagactaaaacactatgtaagtct

SEQ ID NO: 18561 - DNA, 377 bp, Homo sapiens
accccggccgctgcctgcgctttcttccaggcgaggccctgctcggggttcttccggcctccccccaggcaaaacccgcaagagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcagtcactccatgaattcctttgggcaacccagaccagaagataatcagtcagtagtcagaagaatgcaaaagaaatactggaaaactaaacaggtctttatcaaagcaacaggaaaaaaaaaaaaaaaaagg

SEQ ID NO: 18562 - DNA, 541 bp, Homo sapiens
  misc_feature 423..425: n=a, g, c or t
aaaacccggaagcgggtcgcgtggagtgacggtcccaccgcgggggtgagttttgctctgtgttgtgttaagtctgcgcttcccgggtcccaggcgcttctgtacctgggacgtggggtcctcatagacctggaagttctcctccgtctttctttacccagagcaaattgagaagwccccgtgagagtctgggggtcgcttccttttgggtttaaagtcaccatagaccggtcccgtcccgaatctttctgctatagggtaacgtawacacttcccatmgcgtagttttcctgctcaaaacttttttctgactcctcccaacccgcactttttaaagtccttaccgcgagcggattcccgcctgggcgcctcccagtcttgtcttaaggcgccgtcgcccccacctccctcctcgtgccgggnnnvaatgctccccaggtcttccctccgtaatcaccgtttctcctgagcccgcgttggggaggtgcccggggctgtcctatgacaccgtgtgttcttgcctgccctgcaccagcctctg

SEQ ID NO: 18563 - DNA, 378 bp, Homo sapiens
ataacaaaacaatccaactatactgaataatacagaatcaaactgggatccaaaaacaatttaaaacaaagttggaaactcaaccgaaacaagaacaaatcgaatccgacatgaaacaagtctcacaagtgttcttaagctgacagaaagatggtcaaaaccaaacttaaaaccgtagtaatcgacataacggtcataccattcgccgacgattttttctgccctggagctccagccggcgtagagatatcaccagcggctgatggaccatctcctgaaggacccatcgccgagcctgacggagaatctgacggtgaagaagaagtagagcctcccggagccaacgatggagaaacggtgggtgagttttgaaaacag

SEQ ID NO: 18564 - DNA, 427 bp, Homo sapiens
agagcagattcgcacaaacccggaagcgggtcgcgtggagtgacggtcccaccgcggggatatctcttccaaatgsatgaatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaa

SEQ ID NO: 18565 - DNA, 110 bp, Homo sapiens
aatatcttcatgagaacctccctattcctcagagaaacaccaactgaaaagagccaggaaaacccgggaattttccaaaaggtcttcacgttaaacttgtcttatctcag

SEQ ID NO: 18566 - DNA, 449 bp, Homo sapiens
gtttgaaatcacatatagttcactgaaaacccgtatatgcatcatgtaatacatatctaaagttatcttcgttccttgaatgtatactttccttgggatttctgtttagctttcaggagcagtacagtgggggtggggacgggggtaatatagaactgttgacactcgatagctttatactattttctcatctgtagtaaggagacagaaaatctgcactttctttttgctctttaaaaattcttgctttacaggctggacacggtggctcacgtctgtagtcccagtactgtgggaggctgagatgggtggatcacctggggtcagcagtgtgagaccagcctggccggcatggcggaatcccgtctctactaaaaataaaagaattggctgggtgtggtggcaggcgcgtgtaatcccagctacacgggaggctgaggcaggagaat

SEQ ID NO: 18567 - DNA, 495 bp, Homo sapiens
cacaaaaataaatagataactctagtagtcctagaaacttaaaaaaatggaaccatgaaaaccatcttctcatagcaaaagatgtaagcctggtggctctaattgctaaattatactaaatatttaggaaagaaattattctatgttcatacagattcttctactagggaacagaaaagcagatatactccccagatagtcttgtagaaacatgatatagcctagggcagtggctcatgcctgtaatcccaacactttgggaggccaaggtggaaggatcacttgagctcaggagttcgagatcatcctgggcaacatagcaaaaccctgtctctaaaaaacaattaagaaattggctgggtgttgtggtgggtgcctgtaagtcctagctacttgggaggctgaggtgggaggactgcttgagcccaggaggttgaggttatagtgaactatgatggcaccactgcactccagctgggtcaacagattgagact

SEQ ID NO: 18568 - DNA, 414 bp, Homo sapiens
attcatatattcttatctacccagtctcttgatttttgaaaagatttcacctacagtagaatattacagaaacaaaatataaatgcatgtctttctaaatgaaacttacatagactaaaagtagagaatatttttaaacaaatatacaatgtgcaggcagacaaagcaggaaaacggccattcaaatgtataataaaaaactaaaaattgactatctccagaaaactatgaagcgcctcaactaaaaggaatgcataatgaaattctaatctaatacaggtcaaaaatgtaaaaaggttataaaccttaacaggaaaaataaaacaacttttactggccattcctgttgaaatgagaatcataaagtaacagaaaagtggctacaaacccacttagagcaaaaaaaaaaaaaaa

SEQ ID NO: 18569 - DNA, 352 bp, Homo sapiens
attttcatttcatatgatgctagccactgagaactgggctgaatctaagcttatcaaccttccttctagttacagagatggaaagggaatatgaccatcactcatgtggaagttgagccattagaagaaagtccacacatcttatctgccagtaaaaacctactctcaccagatgtctcttcattcaagcaaggaaactgccacagccgccccaaatttctgcaaccaccactttgaacagtcabcagccattaacattgaggcaaaaccctctaacagcaaaaaggttactacttgctaaaggcttagatgattgttaagactttttgcaataaagtgtttttttttaaaa

SEQ ID NO: 18570 - DNA, 359 bp, Homo sapiens
attttcatttcatatgatgctagccactgagaactgggctgaatctaagcttatcaaccttccttctagttacagagatggaaagggaatatgaccatcactcatgtggaagttgagccattagaagaaagtccacacatcttatctgccagtaaaaacctactctcaccagatgtctcttcattcaagcaaggaaactgccacagccgccccaaatttctgcaaccaccactttgaacagtcagcagccattaacattgaggcaaaaccctctaacagcaaaaaggttactacttgctaaaggcttagatgattgttaagactttttgcaataaagtgtttttttttaaaaaaaaaaa

SEQ ID NO: 18571 - DNA, 397 bp, Homo sapiens
attttcatttcatatgatgctagccactgagaactgggctgaatctaagcttatcaaccttccttctagttacagagatggaaagggaatatgaccatcactcatgtggaagttgagccattagaagaaagtccacacatcttatctgccagtaaaaacctactctcaccagatgtctcttcattcaagcaaggaaactgccacagccgccccaaatttctgcaaccaccactttgaacagtcagcagccattaacattgaggcadmaccctctaacagcaaaaaggttactacttgctaaaggcttagatgattgttaagactttttgcaataaagtgtttttttttaaaaaaaaaaaaaaaaaaaaaaaaaaaaaaaaraaaaaaaaaaaaaaaa

SEQ ID NO: 18572 - DNA, 359 bp, Homo sapiens
attttcatttcatatgatgctagccactgagaactgggctgaatctaagcttatcaaccttccttctagttacagagatggaaagggaatatgaccatcactcatgtggaagttgagccattagaagaragtccacacatcttatctgccagtraaaacctactctcaccagatgtctcttcattcaagcaaggaaactgccacagccgccccaaatttctgcaaccaccactttgaacagtcagcagccattaacattgaggcaaaaccctctaacagcaaaaaggttactacttgctaaaggcttagatgattgttaagactttttgcaataaagtgtttttttttaaaaaaaaaar

SEQ ID NO: 18573 - DNA, 388 bp, Homo sapiens
attttcatttcatatgatgctagccactgagaactgggctgaatctaagcttatcaaccttccttctagttacagagatggaaagggaatatgaccatcactcatgtggaatttgagccattagaagaaagtccacacatcttatctgccagymaaaacctactctcaccagatgtctcttcattcaagcaaggaaactgccacagccgccccaaatttctgcaaccaccactttgaacagtcagcagccattaacattgaggcaaaaccctctaacagcaaaaaggttactacttgctaaaggcttagatgattgttaagactttttgcaataaagtgtttttttttaaaaaaaaaaaaaaaaaaaaaaaaaaaaaaaaaaaaaaaw

SEQ ID NO: 18574 - DNA, 400 bp, Homo sapiens
ttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttaggacagcattggcccyckgaggttggtwaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagt

SEQ ID NO: 18575 - DNA, 487 bp, Homo sapiens
aatgagtaaagaaagaaaggattttaggttatagcattttacaccaaattaatgtgtttagctgcaatttgaaagcttaatgtgtttttgttatttctctattttaaattgagctgctgaatattttatagattatgagaaacagaaaacaaaaaaattgaaaaaacaatggcaattttgtgatgttacatttgcaaatgcaatgaaaaaggtaacaactcattgggagaatttcaaaatatgacaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgg

SEQ ID NO: 18576 - DNA, 499 bp, Homo sapiens
tagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggkttattcattctggaaacatgttgat

SEQ ID NO: 18577 - DNA, 497 bp, Homo sapiens
agcgagactccagcagctccagcctccaggattctcagctccctcccgggcgagacctcggacgttcactgcgagcagccgctccgcccgccaccgcctccatctcctcctctggacccctstccaataaattggaggtcccggcggccaggaaagccacgtctcctccgggctgggtcagggaggcaggggccagagcctcagggtcccgtggcaccaacctggcttctggcccactggtcccggaaccgctgcggacgctgcgccccagccgccaagacgccgcgtatcttgtaccgcgggaaaagcgggtcctcgtccaagatgggccggcaggcttggggggtgccagcgctgcgggcgctccatgcagcgctcccagagccggagtagcctgtctgcctccttcgaggcactggccggctactttccctgcatgaactccctggaggaggaagaaggagaagcaggaggtaaaaaactaaggagcactgtcc

SEQ ID NO: 18578 - DNA, 494 bp, Homo sapiens
ttggaataatatgataccagagagagagagcttctatgtgaagctttgtggatttgaaaactgctatactgaatattttatgatcttgtcaaggcctccccttatcatgtgacctcaaggcgctaccatggctttcatcttgtgaagtcttgaacatttgtagttgcagaaaaacctcaagagactcagtatttcaaaagccatagtttaggttttattttctaggctgggatgtttgtgggttttcttattataaaattagagttgtcatagtgatgttgtgtatttcaaaccagatattctgtggtcgcagcaaagtctcactttaggaaatggatttctttatgaatgtgctaacattgtgcacagaaagtagcacaatacagataaacaggcatctttggtaggtggggtgtttgggtaaatttaaatttctgaggattgaacaaaaactcctttaccttaagaactgtgcaagcactttgggaggccga

SEQ ID NO: 18579 - DNA, 427 bp, Homo sapiens
agagttccgggagggtgcaggcaggagagggaaaggcagcagcggcggcactggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggatgcgtattggatagcaatgaatagttctctgaaatgtaaaaccctcagcgacatctttctgcttttcaagagttccgatttcatcactcgtgacttcactcagccgtttattcattgtactgatgattctc

SEQ ID NO: 18580 - DNA, 266 bp, Homo sapiens
actacgcatgtgtgtcaactctagggttgggtgctggggttgcggctttcggttaacaccgcagcaccacacctgttggtgttcagatggagcggcacactagtcatcctaacagaaaagttccagccaaagaggaagctaatgctgtgcctctctgtagagcaaaaccctcccccagctatattaatctttcaagcaagttccccaccagccacttttctgaacatccagacaacaaagctgccctcggcccaaggaatgcctag

SEQ ID NO: 18581 - DNA, 507 bp, Homo sapiens
atctcgacccaggaagtccagctggcttcacctctcaggaacaggctcatattctaacgaaacatatatgtctcttcagcagtgatgaaattgccatataaaatgcacacctgacaattagaatagcaccaaacatttgaatccatttgatgctaaggctttttctcaatatccaatttgtaatgcttatgagtcaggtcaaatggaaacattgcascaaagatcatgactataaccacagccacttggaaattaataactttttttaaaaaaagaaatttctggaaaggaaaacctttagaaaagatgtggctctgaagcatttatcctctaagtctgtaattgccctgatcaatggagtttagctccatgaaagtgaaggctttccccagaagatgatggagaccggccttgtcctgcagctgtttcataaaggcctagaataaatttcaatttcaataacttcattggcatgacaggggagacttgttttgtgaaggtcaatat

SEQ ID NO: 18582 - DNA, 364 bp, Homo sapiens
caccatggagtaacaagtatgaccctcccttggaggatggggccatgccgtcagctcggctgagaaagctggaggtggaagccaacaatgcctttgaccagtatcgagacctgtgcttctgaattgttggatcctgatgaatcgcaatcaggactatgtttggcttgagctccagcctcatgaccaccaaccccatcgaatgactgagagctgccaggctcctgccacgttggagctcagaatcctcccgtggggacactgtgctgcagccagcctccagggagccgcttgttttatggccyaaaaagtctctttatgctgagaaggtcacactggactttgctcacacagagatttgacccaa

SEQ ID NO: 18583 - DNA, 434 bp, Homo sapiens
ggtcgatcctgggccagcatggcggcgccatgtaacccggtccgtgccgcaaagcgaacggcggccgcggcgcggccccgcgggggtttagaggtcaccatgctgagggtcgcgtggaggacgctgagtttgattcggacccgggcagttacccaggtcctagtacccgggctgccgggcggtgggagcgccaagtttcctttcaaccagtggggcttgcagcctcgaagtctcctcctccaggccgcgcgcggatatgtcgtccggaaaccaggtaggagttcctaaggtgggacttggggcggaagagagacctcctggaaggctggggtgggtaaggggaccgatgtggcgaattagagccactagatgaggtgagccaaaggtcctgagcaaaagaccccacgtccaccttacacaaagccctaggcctg

SEQ ID NO: 18584 - DNA, 410 bp, Homo sapiens
tttttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgccatgtgagttgctccgttgctgcccccctttttccttttctaggttgacctctccttgcccctaagcatggtaataacagttgcatgtattgagtgcttaccaaatggcaagcattgtgccaaaaaaaaaaaaaaaaagg

SEQ ID NO: 18585 - DNA, 441 bp, Homo sapiens
agaaacttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtaagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttc

SEQ ID NO: 18586 - DNA, 67 bp, Homo sapiens
  misc_feature 2,4: n=a, g, c or t
andnccctccgcccaagttcttctaactcaggctgcgctccgatctgtcatcgcgttatttcgcact

SEQ ID NO: 18587 - DNA, 180 bp, Homo sapiens
  misc_feature 71: n=a, g, c or t
aaaaccctccgcccaagttcttctaactcaggctgcgctccgatctgtcatcgcgttatttcgcactccancccyccccccacccccgaaaagtgaagttmaaytccctaamagttctsgyttccccaaamaaaagggaaaaaagtgaaaaaaaaaaaaaaaaaaaaaaaaaaaaaaaar

SEQ ID NO: 18588 - DNA, 193 bp, Homo sapiens
aaaaccctccgcccaagttcttctaactcaggctgcgctccgatctgtcatcgcgttatttcgcactccacccccccccccacccccgaaaagtraagttmaactccctaamagttctcgyttccccaaamaaaagggaaaaaagtraaaaaaaaaaaaaaaaaaaaaaaaaaaaaaaaaaaaaaaaaaaaam

SEQ ID NO: 18589 - DNA, 456 bp, Homo sapiens
  misc_feature 90: n=a, g, c or t
ckgtggacggttgaccaccagccaccacatcatcccagagctgagctcctccagcgggatgacgccgtccccaccacctccctcttcttntttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccag

SEQ ID NO: 18590 - DNA, 498 bp, Homo sapiens
atatgttgggatgtcacaaatggacttagcctacagagatttatattcaacttttgaccagagagttccattttaatgtgacactgagagtaaaaaactatcttttcctccttacctatttctcttcctacattcttggccaggaggaaggcactgctacatacccagtcttccccagcagagcctgagcagctctgttttccttctacttcccctcttctttcacatctcatgaccaagcacttcctattctgtctcccaaatgatcacagactttttcctccgcttttgtcactgccactgcccttagcattactctgcctttagagaaagtctcttaatttgtttggttgcttccttcagtccttattatacagaccactacacacacatctgacagagacttttcaccttttcatggttgaatgactgaaattcccagaataaaattaaaaccaccccagcatcaaatttgaggtcaaatagaggtgggtttgt

SEQ ID NO: 18591 - DNA, 452 bp, Homo sapiens
aaccttaaaacctgcatacctcttcttacagtgaggagtatgcaaaatctggaaagatattctaktttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcdatgcatgaggggaatgcagtgtcagtacctggcctatttttaaactagtgtaatcaccctagtcataccattcagtatgtttgctttttaaaataagtaaccacaattaagttgttgtagccttgcacttcaagagatctagtctt

SEQ ID NO: 18592 - DNA, 584 bp, Homo sapiens
aaaatagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgstattccgttgct

SEQ ID NO: 18593 - DNA, 288 bp, Homo sapiens
attaataaacctccaagatgaagatgacacgttgatttcttgtttgaaattaaccaagtcccgagaaaagaaagtgaatagtgttagcacgaggaggaaggaagaaatggagattagattggatactctttctgcatcactgggtagatccagcactttaaataactgcaacttggaagataaattagcttggtatgaaggtgaagcttacatgtggcatcactggaagccttttcctgaaaaccctctctggacatgtcttgatttccaaatagcacaagttggacc

SEQ ID NO: 18594 - DNA, 450 bp, Homo sapiens
aatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagtaagtaggagaattgcttccctttcggtttaaaatctctctgaggccgttccttgctctctgcctttcttccttaggaccatgtagacaaccccattcaggtagtgttcccgcttaaaaccctctgcttgggccccgcgccaagtcgagtcctcattcgggatgtggactagcgcccttcgcgatccccgagctcctccgtcgtctgcccctggaggggagcgcccactgtccggctcctgaaggagcsctttctcctcccacgtcctgggattctgcagaccctccctgtcgtgagg

SEQ ID NO: 18595 - DNA, 510 bp, Homo sapiens
gcgccagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggtagagtgatactttactcaagtgaagtgatattcttggtgggtcattctgtctccttcctttgtgaagtacagggcgtcggagttgcaaatcttctctgagtctgaagtgtccttcctgacacatttgctcatgctcatccatgcttttcctcagttcctctcatcttatttagattccatctcaccatgatccagtgacatgaacttgggaagaggctgcactgggcatg

SEQ ID NO: 18596 - DNA, 553 bp, Homo sapiens
ttcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaataaaaaaaaaaaaa

SEQ ID NO: 18597 - DNA, 437 bp, Homo sapiens
gatttctggatattagcatctacatttttaacatgaaagttttaaattatatgatctccaaagtcactttctttctaagactgtatgactttgttattctaaggaaattccaaaatatttgctgtacagtgagaccaggaatgataactctgggaaaaggaaaatcagtgaataaagagacaacttcaactaatgttgaatgccaaagtgtaaacgttgatcgtgtgacaaatgtaaattgattcatgaggagagactgtggtttggtgcaaagaaagtgttctggaattggaagatctggatcagactcaggctctgtcagataatggctgtatcatctttgaaaagcaaaacaatctactaatgaaatcagaaggatttccagtgatgctgcccacatttctgtgaaaagaggaagttttttwagtcagatggaa

SEQ ID NO: 18598 - DNA, 406 bp, Homo sapiens
cacaaaatggtagccgccgtgggggatgtccagttttttttcctcttcccaagtacagacgcagagcagacttgtctttccgcttaacctcaacctcgtgtgatctgccagtttcgctcccgacgccaaattccagcgaaacagctgatgccagccagcttgaagacccctgccacagaagaagggaatcagcatgagaatacatcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtggccctatgattaaacctctttctcttctgcaaaaaaaaaaaaaaaaaggc

SEQ ID NO: 18599 - DNA, 531 bp, Homo sapiens
agtagctaaggtattgccctttcacactggcagtcagatttgattccctacttagaaaaacctgattggatcttctgagaatatcagagaaagactgtccttgccatccacactacagcaaaactggatccttgaactttggggtcataatctcacaactgagaagagttcctcaacactcctggaactgtacctccattggtacccttaagcctccaactgcaattctcaacacacgcttaacactactatccgccagtgaggaaggactttccacgacttctgaagcaacatattaaggacaaagaataaacacagaagaatcaggtatactcgcaagaggaagaagaggtcaggaaagccttcacataagaagtggtgcttcttgaaggaacagaggtgcttcttgaaggaacagaaccatgtgcctgcctcaccttgctgttctgaagatttagtaacatcatttatttcaagcattcagcatacctgcagtccacaaatgttagtgaaaaacaaaaaaaaaaaaaa

SEQ ID NO: 18600 - DNA, 516 bp, Homo sapiens
acatctccacaggcttggcgacgcatgtttcaagggcagcgcggttggttttgcggcasgttascaggatctgaggcaattctgggtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgctgtagctaatgccaaaataaaaaactcggtggctttgggtcatttcattcttcctcctgcgtgcctgcaaaaagaaataagaagaaaaattggtagttttatttgggaacaagaccaacattttctgatagaaaagcatgatgaagtaacaccaaatgaaataaagacccttagggaaaacagtgaactagcaacagagcacaaaaaagaattatccaaaaggtggagtctcgttctgttgcccaagctggagtgcagtggtacgatcttggctcactgcaa

SEQ ID NO: 18601 - DNA, 496 bp, Homo sapiens
aattaggaaaacaggtggtgggaagtcattctgagcagagggaagaacatgcgggaagccatagagcgtcataaggcatgaccctatcccagcgctgctagagggcccctatttgtgaccaattgtaagatcatctgaagatcgagtccgattgcctggccaggccgggctgggtggtatgtgcccccgtcacgccggagttcctgctttagcgacgccaaagattgggtgtgagggcagcccgcggtgacagagacacggatcggaccgagagaaaaaggctgtgggcttcactgagcagagtgacgtcaattcacaggacctccacagtgtgccttttgctgggtaggaaaatgccagccagcttggaaaacaagaagacacatttatgtctaccatgagcattggcatcagccaattatcccacacgttttcggctagccagtgctgaagagagcaagaatttcaacccttcttgctacattcaagacataga

SEQ ID NO: 18602 - DNA, 314 bp, Homo sapiens
cataactcaacttggcacttgcataaatatatacaactataatttgtgagcttacaataaaaaatgtctgggacatattaacactgagatttttctattaagcctatgtgcaccaatggtgagaaccactgaacttaggattcgaagattatactgcaacctccaagagactagaggtacctccaaagcaagaggtactacataaaataggaaagtccctgaatcttctgtattcaatttaatgaattaatgcaaatgataatgtaaccaccaccctgatcatctgcttctcaaagggtggtccaaggactagc

SEQ ID NO: 18603 - DNA, 433 bp, Homo sapiens
gatatggttttagaagagtttaattttactggtattttggaggtgttatacagaaaaaggctttgtaacttgtagcttttccaaacagtacctaccatgaccagtaagaatgatgttaatagatatggtggtagagaaggctttctcctaggcggcgggcctcatgaaaatagatgcaggctgggcgcggtggctcacgcctgtaatcccagcactttggaaggctgaggcaggtggatcacctgaggtcaggagttcaagaccaacttggccaacatggtgaaacctgtctctgctgaaaatgcaaaaattagctgggtgtggtggcaggcgcctgtaatcccagctactcgggaagctggggcaggagaatcgtttgaacctgggaggcagaggttgcagtgagccgagatcgtgccactgcactccagca

SEQ ID NO: 18604 - DNA, 419 bp, Homo sapiens
atgtgacttcggcaagatggctgccctgacagcggasattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcascgcctcactaggctggtggcattccgtgacctgtcctctgccgaggcaattctggctctctttccagaaaatttccaccaaaccctcaaaaacctgctgacaaagatcatcctagaacatgtgtctacttggagaaccgaagcccaggcaaatcagatctctctgccacgcctggtcgatctggactggagagtggatatcaaaacctc

SEQ ID NO: 18605 - DNA, 176 bp, Homo sapiens
aaaaaattagcattacctgggaatctgtttaaaatcattgacaggcctgagagttttccatacggcctgcaccctaacctctgggaagaaaatatccacaatgaaatttctacaagattagaggaaggagagaggcaacggggattccatttctactaggagtatcaacctctgag

SEQ ID NO: 18606 - DNA, 390 bp, Homo sapiens
  misc_feature 84: n=a, g, c or t
gagcgcagasgtttggtcgttcgttgggcggtgctggtttttcgctcgtcgactgcggctcttcctcgggcagcggaascgcgncggtcggagaagtggcctaaaacttcggcgttgggtgaaagaaaatggcccgaaccaagcagactgctcgtaagtccaccggtgggaaagccccccgcaaacagctggccacgaaagccgccagaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgc

SEQ ID NO: 18607 - DNA, 396 bp, Homo sapiens
  misc_feature 80,178: n=a, g, c or t
gagcgcagasgtttggtcgttcgttgggcggtgctggtttttcgctcgtcgactgcggctcttcctcgggcagcggaasnacgcgcggtcggagaagtggcctaaaacttcggcgttgggtgaaagaaaatggcccgaaccaagcagactgctcgtaagtccaccggtgggaaagcyncccgcaaacagctggccacgaaagcskccagaaaagcgctccctctaccggcggggtgaagaagccthatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcascat

SEQ ID NO: 18608 - DNA, 469 bp, Homo sapiens
gtttagaatgcaaggsttcctcaattctccacccttcccctcttgacatcttgctcttcttcccttcatctattgtgttagtcaggtgcatgctggtcttccctctatcaaactgtaagctacttggagacttgggatgcctcactcatctctattcccaaacctcagggtctatcattctaccttctgtatagacaggactttcatagttttgaacaagtcagaacctgaaagaatttgcttccagaacaggacattgacaggaaaattaagcatgatcatgcagtaaaataggaataagaattggacctacctcaagatctgttgagaagattatgagagagctgatggatctaaaarrwttggcgcttggtaatgactgtcaattctttctattacttctgtgtgtaattcatcacctattcttgttcatcacttgcgaaaattgtamccctttctgtactgagta

SEQ ID NO: 18609 - DNA, 254 bp, Homo sapiens
svdatgtatcgccgctcagctttccctaaggcagccatcaaaaggcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggt

SEQ ID NO: 18610 - DNA, 417 bp, Homo sapiens
gctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccctttcattgacctcaactacatggtttacatgttccaatatgattccacccatggcaaattccaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagccattaaa

SEQ ID NO: 18611 - DNA, 222 bp, Homo sapiens
taacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagaca

SEQ ID NO: 18612 - DNA, 346 bp, Homo sapiens
ttataatttataattatgaaggaattataaaaagggaattttgtttttatgactagaggtagatttactgtgaagctaacaaagctgaagctgcagagcccttgcttgtctaggttttctctgaccctgttcttaatttaatttaatttaaaaaagtgttttttttgagacggagtcctgctctgttacccaggctgtgtagagcagtggtgcaatctcagctcactgcaacctccgtctcccaggagagtcgcttgagcctgggaggtggaggttgcattgagcctacattgtgccactgtactctaacctggcgacagagtaagactctgtctcaaaaaaaaaa

SEQ ID NO: 18613 - DNA, 480 bp, Homo sapiens
attttctgtggtccaactaccctcggcgatcccaggcttggcggggcaccgcctggcctctcccgttcctttaggctgccgccgctgcctgccgccatggctggtggaggacaccttcaccatagatgaagtctctgaagtcctcaatggattacaagctgtggttcatagtgaggtggaatctgagctcatcaacactgcctataccaatgtgttacttctgcgacactgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagacc

SEQ ID NO: 18614 - DNA, 410 bp, Homo sapiens
agacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagggaccaagtcatatgctgagggggagggagagcatcaggaagaatagataatagatgctgggcttaatacctaggtgatgggatgatctgcacagcaaaccaccatggcacatgtatacctatgtaacaaacctgcatatcctgcacatgaacccctgaacttaaaataaaagttgaaaaaaaaaaaaaar

SEQ ID NO: 18615 - DNA, 269 bp, Homo sapiens
gtgcgtgccgctcggcgwssgggacgggcctgcgttctctcctccttcctccccgcctccagctgccggcagsacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaaaaaaaaaaaaaaa

SEQ ID NO: 18616 - DNA, 517 bp, Homo sapiens
agtctacattttgatgccacgttgggcaaatctccttacctctatggtagtcatcactattttttaaagctaggagattatctcagttccttttaaaacagcttttatagaaggtggttgagttttccactggaatttcaaactgtaatcctagcaaatcgaatgacctctttacactggccaattattcatctgccaaataataacagccaccactgatcacgtgggagcttacccaatgccatgcgtgcactatgttctgaacgtgcacaccaggcgatctctctcatttagtgctcacaattttgaggtagacattagctccatttaactgatgaaaaaactgaggctgaacgaagttaaaaacccatcatgcagcatctgcagagcggcggttctaaaaacgcctcacagtaagaaagaattgctaacaaacagtagctttgcctctaagcgcccgcttttcctctaatattcacagacgggtatttagaacgttaaagagccggaagccttg

SEQ ID NO: 18617 - DNA, 500 bp, Homo sapiens
  misc_feature 163: n=a, g, c or t
agtctacattttgatgccacgttgggcaaatctccttacctctatggtagtcatcactattttttaaagctaggagattatctcagttccttttaaaacagcttttatagaaggtggttgagttttccactggaatttcaaactgtaatcctagcaaatcgantgacctctttacactggccaattattcatctgccaaataataacagccaccactgatcacgtgggagcttacccaatgccatgcgtgcactatgttctgaacgtgcacaccaggcgatctctctcatttagtgctcacaattttgaggtagacattagctccatttaactgatgaaaaaactgaggctgaacgaattaaaaacccatcatgcagcatctgcagagcggcggttctaaaaacgcctcacagtaagaaagaattgctaacaaacagtagctttgcctctaagcgcccgcttttcctctaatattcacagacgggtatttagaaacgttt

SEQ ID NO: 18618 - DNA, 508 bp, Homo sapiens
cagatatttgatggaaagtccttaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggcatggttgctcagcctctgagggcaatacaggcatttaaaaaattaaaatgaccaggcacagtggctcacgcctgtaatctcggcactttgggagactgaggtgggagcatcgcttgagaccgggagtttgggaccaggctgggcagcacggggagaccccctctctacaaaaacatttttaaaaaattagctgggtgtggtgatgcgtgcctgtggtcccagttacttgggaggctgacgtgggtggctcacttgggcacaggagtttgaggctgcagtgacctatgaccacatcactgtacgccagcccgggtgagagaggg

SEQ ID NO: 18619 - DNA, 483 bp, Homo sapiens
tgtttaatataattgtatttataaatgctgatagatttaaaggttttaaagttttatatttttattattgcaggatagaaggataaaggatgcatgtgtagtatttttattttgaaaggaaaatgtacaatgtgtgaacaaaaacattaagagatttaatatactattttcttattttagatttttacattcaataagtataaattctcatctatataaggtattgtgtgcaaatttgggaaaaaactgattagcagccatttagtagaagctatgcctctgatttttaaagaatggtttcaatctggtttaagcttctgagagaattttggataatgggatagatggtaacatttttttcttatccctgttacaggattctagatttgtgcagtaggattgtgggactgtgttttaggagagaaggatgtcttggatgtccagtttctgtggttaatccttacttgcttatccagtgacagc

SEQ ID NO: 18620 - DNA, 63 bp, Homo sapiens
gattggccgtgttgtacggcggsttctcgcgcmtgatgacctkgaagtgatgcctaaagctgt

SEQ ID NO: 18621 - DNA, 492 bp, Homo sapiens
aaaccaggagttctataaacgggttcagctgtgggagtaaaataggagtaatttcatagcttctccgtataattgcactgtatctgtaagagtagaagacgtcaatcttaaaagatttgaggaggttatttccacacattaaaagtgggtcaaccaaaaccgcatggcgtactactctctgaagcctctactaccctgctcctccgtgttgacatgtggtcaggcaagccaggacttactcacatcagctacatcagttactgggatggagaaaattgaagcctagaaggatcaagaaactttctccaggccataaatagaggaatcaggattcaaatcagatagaccccagggcttgttctcttcaacaccacattaccctacattattattcaattattaaataaaaccttgcattagtggcatttccaaatgcataacaaaaaaataaaaaaaagtaacactggtaaaaaagaaaaaaaaaaaaaaatg

SEQ ID NO: 18622 - DNA, 470 bp, Homo sapiens
cagatatttgatggaaagtccttaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcgcttgagaccgggagtttgggaccaggctgggcagcacggggagaccccctctctacaaaaacatttttaaaaaattagctgggtgtggtgatgcgtgcctgtggtcccagttacttgggaggctgacgtgggtggctcacttgggcacaggagtttgaggctgcagtggaccta

SEQ ID NO: 18623 - DNA, 437 bp, Homo sapiens
aaaattatgcttgctcacattaatggtcaggaaaaacagcaactgcagaaagcagataatctatgccatgtccattagacactaacaccagtattggttttagctctattttttgtaccaccatatggatttgtacattttcccccaaacctggtcacctattgccaaagactgggactttttacatcccatggagaagtttcccagcatgattgatcacccactggaaaactctaatattgtacagtgggctcttgaaagtgaagcaaagaacvttcttggtgaaggaggaattggacaagccctaagataaaattttgcctggagaagtgaacagttattgaagacatcttcctgattttaaggcaaagttgttatctatgcaacaagccagagaaactgcagttcaacagtacaaaaaactggaagaggaaatc

SEQ ID NO: 18624 - DNA, 479 bp, Homo sapiens
acttccggttctctgtcagtcgcgagcgaacgaccaagagggtgttcgactgctagagccgagcgaagkttgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggattgcagaagaatttgtaagatgaatacttttttttaatgtgcattattaaaaatattgagtgaagctaattgtcaactttattaaggattactttgtctgcccaccacctagtgtaaaataaaatcaagtaatacaaaaraaaa

SEQ ID NO: 18625 - DNA, 405 bp, Homo sapiens
acttccggttctctgtcagtcgcgagcgaacgaccaagagggtgttcgactgctagagccgagcgamgttgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacttttttttaatgtgcattattaaaaatattgagtgaagctaattgtcaactttattaaggattactttgtctgcccaccacctagtgtaaaataaaatcaagtaatacaaaaraaaaaaaaattgc

SEQ ID NO: 18626 - DNA, 325 bp, Homo sapiens
aacgaccaagagggtgttcgactgctagagccgagcgamstgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatg

SEQ ID NO: 18627 - DNA, 331 bp, Homo sapiens
  misc_feature 41,322: n=a, g, c or t
aacgaccaagagggtgttcgactgctagagccgagcgvstngccctaaatcaaaggaacttgtttcttcaagctcttctggcagtgattctgacagtgaggttgacaaagttaaagaggaaaaagcaggttgctccagaaaracctghaaaggaacaaargacaggtgagacttcgagagccctgtcatcttctaaacagagcagcagcagcagagatgataacatgtttcagattgggaaaatgaggtacgttagtgttcgcgattttaaggcaaagtgctaattgatattagagaatattggatrgatcctgaaggtganatggaacca

SEQ ID NO: 18628 - DNA, 474 bp, Homo sapiens
tccctgtgatggactggagtctgtctaggatgggttcccgccttgccttctgagctgctaaaataggctgcagcgatccactactgtaaactggaataagcatgtaaataattatcttgttcttattgttcttaattctatgcatagcttatatttatttcagtgtttaatattagaagtattttagtctttagaagtttggtgatgctgtaaccagaaatatttggtaggaacttaactcttatctatttcaattagcctgttggtaaaattggtttccttatgtgtcgcttaacttaaaattacagtttctaaaaatctgtcaacgatgttaagtgaggacttactgtactttatttcttctaatgcctgaataatattctgttaatataccacattatgtttgttgatgggcatttgggttttctccatgtttttttcaattataaacaataatgctgcgaaaaaaaaaaa

SEQ ID NO: 18629 - DNA, 452 bp, Homo sapiens
aacgaccaagagggtgttcgactgctagagccgagcgamstgcctaaatcaaaggaacttgtttcttcaagctcttctggcagtgattctgacagtgaggttgacaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttatgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgt

SEQ ID NO: 18630 - DNA, 493 bp, Homo sapiens
actggcagattattgcaaaaagggcacggggcagagggactatgttgtgagcctgcgaaagaagtttgtgtggggactgtgggcagtgaatgcgttgggaacaatatggaaaactgggagctgccttggaatctacagggccgggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagtt

SEQ ID NO: 18631 - DNA, 471 bp, Homo sapiens
gttttgagccccggaggcagagcggctgccatggccaagtacctggcccagatcattgtgatgggcgtgcaggtggtgggcagggcctttgcacgggccttgcggcaggagtttgcagcctctaccccctaaraaaggraaccactcctggagaagaggcagctcctagccacctgtccctgtgtctctcatcctgtgctggtggcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctc

SEQ ID NO: 18632 - DNA, 441 bp, Homo sapiens
acccgccgacsacgcttgatccccggccgcggggccaggaagtcggagtttgagccccggagcagagcggctgccatggccaagtacctggtccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggccaaggaggacagagaaaaaggggcagat

SEQ ID NO: 18633 - DNA, 442 bp, Homo sapiens
acccgccgaccacgcttgatccccggccgcggggccaggaagtcggagtttgagccccggagcagagcggctgccatggccaagtacctggtccagatcattgtgatgggcgtgcaggtggtgggcagggcctttgcacgggccttgcggcaggagtttgcagccagccgggccgcagctgatctccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatcccaggccaaggaggacagagaaaaaggggcagat

SEQ ID NO: 18634 - DNA, 441 bp, Homo sapiens
acccgccgaccacgcttgatccccggccgcggggccaggaagtcggagtttgagccccggagcagagcggctgccatggccaagtacctggtccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggccaaggaggacagagaaaaaggggcagat

SEQ ID NO: 18635 - DNA, 104 bp, Homo sapiens
  misc_feature 68,76..77: n=a, g, c or t
gaggcaatgcgcatgcccagcgccgtatcgcgcacgsctctctgcggctttccttgacctctgacccnycgaccanncttgatccccggcsgcggggccaggaa

SEQ ID NO: 18636 - DNA, 433 bp, Homo sapiens
  misc_feature 421: n=a, g, c or t
acgaagacgaccgggctctcaagatggcggccccatgcggaaacagctccagggagcagccatgttgcttcctgaacaaagcctctgaagatgcggaacgggcaaaaccgcccagtacggaacggcgcastcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaagggtgagtctgtgggattggtaatgggaggagaggagcccgtgaggtcagtggtaggaggtttatgaaatcactggtgggggaagtaggtgggattaatgttggatttatgtgggaktccgagatgtgattagtaacagggaagtganaggtgagggggt

SEQ ID NO: 18637 - DNA, 489 bp, Homo sapiens
agaaattgggaacctgggcttctcagaagctgttaactagatggggaataaaaaactgtgtagataatggcaaattgggcagaaatttctaagaattgccttgaatgtgctattacacatttatttatgtagtgctaacaagataaatgtatgtgtaaaaagctagatatttaaaaattcacttagatgattacgaaatacggttttgatttgatgtgtatttcaataagaaaaggttgaaacagccttacagtattaaggatgttattagagataattctgatattactcagaacaaatatatttgctatcaatggcaatttctatttagctctttctccttgtaaatgattttgtgaggtgcctggcagatgatatccgcagatggcatacaaaggcacattggcacacaggaacagcctttgctggccagttctgccatagccaaatttagggagcaggaagatggtaaaacgacaaatcattaag

SEQ ID NO: 18638 - DNA, 383 bp, Homo sapiens
gcctagtggagtgaggggtaacaagatggcgaccgagacggtggagctccataagctaaagcttgccgaactaaagcaagaatgycttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagacacctcatggcacttcaaactattaaaatgcattttatcttaaaa

SEQ ID NO: 18639 - DNA, 405 bp, Homo sapiens
  misc_feature 126..127: n=a, g, c or t
ggagtgaggggtaacaagatggcgaccgagacggtggagctccataagctaaagcttgccgaactaaagcaagaatgkycttksskcgtggtttggagaccaagggaataaagcaagatctkatvnncagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaakkacatctgaaataccacagactgagagaatgcagaagagggctgaacgattcaatgtacctgtgagcttggagagtaagaaagctgctcgggcastaggtttgggat

SEQ ID NO: 18640 - DNA, 474 bp, Homo sapiens
atcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttrctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggraacaaataaagatagatgtgtctgagt

SEQ ID NO: 18641 - DNA, 540 bp, Homo sapiens
aaccagggagactgcagtttgcagtgatgtggctaagatacccttgtgctattaaaggcacatttacgtatctttcaacgcagtttgtacctttgtttagggttctattgaactttctctgtgctctttagaaaaccgtcgaatgaaggtaaccatctttttgggtgcctgggcatggtcattgtcccagagttttaacataagtctctactaaagtatcctgatttgcaagggaggtcatggaccaagtacaaagcggcaaaaggatggaattaagggatatttccagtgaaagaaagaagaaagcatgcttttctcttgactgtgcagaaaaaaaaactatgtttctttgattctccattttactagatgccatacctttgcaattacttcatgtggagtcttgaccaasattcaggaaatactagaactttcagtcccagaaggttactctgggcattactagtccccatcattatgagttgagttttastagttaatttcagacgaaaaatattgttttcccaaaatctgggttag

SEQ ID NO: 18642 - DNA, 443 bp, Homo sapiens
aagtcatatgcccacttttggggaccttcatttaggtgagctgccacgtccggagagggcagcaagaatgaaagacctctagttttccagactcccggagccctsgtctctacaccacatggacgttatccacctcctctgtgtcctcccagcatttcagaaggtgatccacggcaaagcgtcccttcaaatccgtctttgtgcccactgccatagtcaaccccgtgagaagcacagccggcmctgggactttaggacaagggtctcttcggaaagggcggasagcatgagaaagagtaagtggtggcagagagatggatccctgcagagacccctccagtccgggatccccactctcgtggtaggctccctcagacgcagccccaccatggtccttcggcctcagcagttccaattctaccagccacaggggatcccctcct

SEQ ID NO: 18643 - DNA, 459 bp, Homo sapiens
acacaccctcacaggactgcatccacacaagctactcggcgtggtgggctgggccgagagacagtcagctggtctctttgctaagctaccagaagtcggctaacaaaatgaaaaaacttctccagcagggggcgctrgttcctaagtcagakaaaggatttcggggaacacaaggyacggatgcttcatctcccgaggacccgggaggcctcctgagcctttgctgagctttccctggtgctcctttttgcagtccagcgaatccaggggactggggcacactgcaaggggttgtggtggtgctggggctgccagaggagtgtcccaaccaagaaactggcgactgcagactcgacctagcaktcccccacctctggcccacagagttggagccaggccctgtcttggttctcaatgcactcaaaagcttaaatcctagtaaaccctccactgcggaga

SEQ ID NO: 18644 - DNA, 424 bp, Homo sapiens
gtcagctttcctcagcaacatgaagtctcgttcggctggaaaactctgggaactgcagcacgagatcgaggtgtaccgcaaaaccgtgattgcccagtgggagggcgctggacctggatgtggtgctgacccccatgmtggcccctgctctggacttgaatgccccaggcagggccacagggcatgaagaagagtgtggggctgccggtggccgtgcagtgtgtggctctgcctggcaagaagagttgtgtctgcggttcatgcgggaggtggagcgactgatgacccctgaaaagcagtcatcctgatggctctggctccagaggacctgagactcacactctctgcagcccagcctagtcagggcacagctgcctgctgccacagcaaggaaatgtcctgcatggggcagaggcttccgtgt

SEQ ID NO: 18645 - DNA, 477 bp, Homo sapiens
gaaaaggagcaagatggctgactccaaagagggtgttttgccgctgacggctgcttccactgccccaatttcattcggcttcactcgcacgtccgcacggaggcggctggccgactcgggagacggcgcggggccatctccggagraarggatttcttgaaaaccgtggaagggagggagctgcagaggtgacgcgccgggtctttcaccccttggaaatctctgcggtgggctgtgaagccaggaggcccccaaggaactcgtcatccctttgatccagaatggccatcgcaggcagccaccagcccggccccctgggcattccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcgg

SEQ ID NO: 18646 - DNA, 223 bp, Homo sapiens
  misc_feature 223: n=a, g, c or t
akcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgn

SEQ ID NO: 18647 - DNA, 335 bp, Homo sapiens
aatttagcaaccagggagatttctccattttcctcttgtctacagtgcggctacaaatctgggattgcttcagatggtttgctgtatcatttttcttctttttcttttcctggggacttgtttccattaaatgagagtaattaaaatcccttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagttca

SEQ ID NO: 18648 - DNA, 282 bp, Homo sapiens
agcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaattttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 18649 - DNA, 516 bp, Homo sapiens
  misc_feature 479: n=a, g, c or t
agagacagttacgtgttcagtcatacaagtagtttcctctggtaatgcttcactaactccctttcatgagttgaatagtgaagtcagtaattaggcagtttttgcttctcaaagtgctccagacatctgcatacctgttgccctttcacagaaaataggggttgaagtggtttgccccaagtcgtgaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggraggtgaggctgccaaggngaagtacttaccaagactcttcaaaatgatacattag

SEQ ID NO: 18650 - DNA, 263 bp, Homo sapiens
agtcagtggtgtggtaccgggtaccgragacgtgtatcggacggtgggccgcagccatggcmgagagaaaacctaacggtggcagcggcggcgcctccacttcctcatcgggcactaacttacttttctcctcmtcggccacggagttcagcttcaatgtgcccttcatcccagtcacccaggcctccgcttctccggcctccctgctcttaccgggagtttttcatttctaagaagcaagttttcaaaaaaaaaaaaaaaaa

SEQ ID NO: 18651 - DNA, 518 bp, Homo sapiens
atatatacggagtcacctctccccagagaggtcacagccaacattcagaggcctcccagggccccctctccctggataaaccacttcagctgccccccatttttctcgagggagaaaaaggggaatcctctgtccagaatgagcaggaaggagagccaagcctacagtcacccagcttagagctccagtcccctgcgtggccacccatgcagrrktggctcaggagcccctgaaagtgtccagcagctacctcagtgacacccagagcagcgagagtcatgtttccagcgtgcagcacccgaggccagaggagggcagccatgccagcctgagcagcgggtacgcaggggacaaggagggcagcgacatcagcttggtgggcagccaccggagagtgcggctgaacagaaggctcaacacccaggcggccagtaaccaaaccagccagctgggctccatagaccctcccagctctctaaagagscggctgactggcccgccacagcaccaagcagact

SEQ ID NO: 18652 - DNA, 507 bp, Homo sapiens
ttgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggttgcttttcttaagtgcccacatttgatggagggtggaaataatttgaatgtatttgatttataagttttt

SEQ ID NO: 18653 - DNA, 397 bp, Homo sapiens
cggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcatagtttctttaaaaaaaaatacaataatgcaccatatccctatgcataaagkgcttcttctatttataaggttgaaaattctgaataacccttttagcattgaaaaaaaaaa

SEQ ID NO: 18654 - DNA, 218 bp, Homo sapiens
agattccagcgagctacgcaagcaatcctggcccagccgagcttgcttccccaaatcccgtaatccttgaccttattcccccaaagaagcggcctcccgggaaggagcgccctggcgagaagactcgaacggctcccacagccgggcgttgggggaaaggtgggcgrtcttggtcgtgcgaggtcggggagggaaggtsctccgctctccattgcgga

SEQ ID NO: 18655 - DNA, 361 bp, Homo sapiens
caacccgttctgctggctcgagaacgaagtaggccgtctcgctctgggtctccaggcccgcgaccgtccgccagtcgtcccgaggccactcttcacctccaccatgagcctggacatccagtgtgaggagctgagcgacgctagatgggccgagctcctccctctgctccagcagtgccaagtggtcargctggacgamtgtggscytcacggaagcacggtgcaaggacatcagctctgcacttcgagtcaaccctgcactggcagagctcaacctgcgcagaacgagctgggcgatgtcggcgtgcattgcgtgctccagggcctgcagaccccctcctgcaagatccagaagctgagc

SEQ ID NO: 18656 - DNA, 507 bp, Homo sapiens
agattccagcgagctacgcaagcaatcctggcycagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcag

SEQ ID NO: 18657 - DNA, 727 bp, Homo sapiens
ctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacartcctctggatcctctaaatgtgaattttgatgtaataactgctaataaaattatattgaagcagtgttttatagaaagttttttccaaagttttctatgtttggctcaattagggcagtatcatcagttctataatgtamaagaaattttckktcttttgaggtattccataaaagtagttgggaaaattattatgtaaaataataagactcttccaa

SEQ ID NO: 18658 - DNA, 325 bp, Homo sapiens
ctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagacaaaaaaaaaaaaaaaaaggc

SEQ ID NO: 18659 - DNA, 431 bp, Homo sapiens
tagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagt

SEQ ID NO: 18660 - DNA, 411 bp, Homo sapiens
  misc_feature 337: n=a, g, c or t
agttgtgttgtgccaatggtggagaagaaaacttcggttcgctcccaggaccccgggcagcggcgggctgctggaccgggstgcccggsacgtcgcatcarscggcagctggaggccctggagaatgacaacttccaggatgacccccacgcgggactccctcagckrsggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggcctaactacctgacggcctgtgcggkanccccatcgcggccccagcgccccttctgtgctgtctgtggcttcccatccccctacacctgtgtsagctgcggt

SEQ ID NO: 18661 - DNA, 209 bp, Homo sapiens
aaagataatcacggatattaaccagtgtcccatcagaacacctttctccatgtcccaacccatgcttcccccaaaaagggtctgtacttaaattataagctcctcccccttaaattggtacagtagacccaggacttttgtgtctgtgcacagaaaaatgtaaaagactctagaacagtgaagcagttcatcataatgagtacttacta

SEQ ID NO: 18662 - DNA, 501 bp, Homo sapiens
agaacgcccttgttttttccaccacgtgatggcgcagacagaagacaaccagcatctatgaaccaggaagcccccaccaggcactgaatctgcccctgcgtggatcttagacttgcagactccagaactaaccttacaatgtctcttctccattaagaaaacctacttcaacatctccattggttctcaacatagagattctcttaatttaaaggatccaacgcaatgaccaatctccaattgtcaaatattgagtgaggaaaataatcatatttcatcacagtatttaagtaaggatcaaagactctaagataactgaaagcactaaattaattttcttcaccaagatcacaggaaaaacagaaactacaaggagaaatggaaaaagctggaccttccctatggacatggggaaaagtggctatctggaagtcaagggaaaagagagatttttctttataaaataaaagaaatgcctgaaccaccaaaaaaaaaaaaaat

SEQ ID NO: 18663 - DNA, 485 bp, Homo sapiens
gacgtccttggcgtggctgcaggggaggccgcggcggggaaaatggcggacgggaaggcgggagacgagaagcctgaaaagtcgcagcgagctggagccgccggagacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttc

SEQ ID NO: 18664 - DNA, 389 bp, Homo sapiens
gaaattagccccgccccgctgcggctgattcgtctagttaaaccctggtgttcctgacacaaacttcaggaaaggattttgcacttgtsagaccgggcgagcagagtaagaagcaggtcccgcataccaacaaaactaaggacgccaacttgtctggaaggcccaataaaaagctgattcatggaggaatgcaattgtcacatcctaatgatttcatctcccttaccccaacgaatcgataaccccaaattttccagcccctcaccctccacaaatccccttaaaaaactttgcctagaaccccttgatgaaatggattgaagcttgagaactcttcctgtttcctggcttgtwacttgtgattattaaaactttctctgctgcaaaaa

SEQ ID NO: 18665 - DNA, 348 bp, Homo sapiens
gggaaaggattttgcacttgtgcagaccgggcgagcagagtaagaagcaggtcccgcataccaacaaaactaaggacgccaacttgtctggaaggcccaataaaaagctgattcatggaggaatgcaattgtcacatcctaatgatttcatctcccttasccccaacgaatcgataaccccaaattttccagcccctcaccctccacaaatccccttaaaaaactttgcctagaaccccttgatgaaatggatwraagcttgagaactcttcctgtttcctggcttgtaacttgtgattattaaaactttctctgctgcaaaaaaaaaaaaaaaaaaaaaaaaaaaar

SEQ ID NO: 18666 - DNA, 483 bp, Homo sapiens
aaaggcaaggaagcggaagssagaggcggtcgggatccgctgcgcgagctgtctcggtcccacgtgtgcgagttgctacgatggaagttaaagggaaaaagcaattcacaggaaagagtacaaagacagcacaagaaaaaaaacagatttcataaaaatagtgattctggttcttcaaagacatttccaacaaggaaagttgctaaagaaggcacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaggagaaagaactgaagcaaagcagacaactcagtgataaaaccaactatgacattgtt

SEQ ID NO: 18667 - DNA, 403 bp, Homo sapiens
  misc_feature 21,396: n=a, g, c or t
aaaggcaaggaagcggaagsnagaggcggtcgggatccgctgcgcgagctgtctcggtcccacgtgtgcgagttgctacgatggaagttaaagggaaaaagcaattcacaggaaagagtacaaagacagcacaagaaaaaaaacagatttcataaaaatagtgattctggttcttcaaagacatttccaacaaggaaagttgctaaagaaggcacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccangaagccc

SEQ ID NO: 18668 - DNA, 512 bp, Homo sapiens
ataccaagacataccagaattttaggaatctaaaataattttggaatatgtataacaacacatccataaaaatgtaactcaaggagaccacctggccaacatggcgaaaccctgtctcttctaaacatacaaaaattagccgggcgtggtggcatgcgcctgtagtcctcggcctcccaaagtgctgggattacaggcgtaggccactgtgcccggcctgccatggaatttctaagtggcatggctagttcactgtaccggggcattctgacaagagtatgggttcctccccaaagcaaaacctagactccagctagcagtgttaatgctgtgtgtgggtgaccactgatgggcagagaggagacacagcagtgcctcacagatctgagttgcatgggaatctccattcagacccagggttggggtctgggttaggtaggaactcctgccacttgttggtgacatggccctaaatagggctctgagattaggttataaaaataatatggcct

SEQ ID NO: 18669 - DNA, 552 bp, Homo sapiens
agtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccarattccaaggacctcacgatggtgctgaaaacctatgacaccagcttcctggactttctcagaagatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcag

SEQ ID NO: 18670 - DNA, 463 bp, Homo sapiens
  misc_feature 406..407: n=a, g, c or t
accagcaaaacaacaacaataggtggaagactggggccaatagtcaattgtctttaatggaggtggggaaggggataactgtatttatagcaatttaatattatgtctaagagtttagcttcaccgatgaaaccccatgattacttatacttagtcgaatgtgtttacatacatttagttgaaatctagcaacatatctaagaactagtgaagaaagcatacagtagtagcagtaataatatatgaagagaaaatattgtattgaaaaaatttttcaaaagaaaataacttgacactggaaagtggggaatagtccataaaagaaaaaaatcattgttataatgattactaaacataaaaattaaccaagtgtacatgtgaaagccaccatacacaaactgaatannaaggtatgagtctttgcwtcttgtgcamttgtgatttttcaggggggtggggatat

SEQ ID NO: 18671 - DNA, 421 bp, Homo sapiens
atcacggggaggcagggcctcgccacaccaaacctgtggacgccgacccgggaccgccgctggctggctgctggctcactcgaccgtcatggagaccctgggggcccttctggtgctggagtttctgctcctctccccggtggaggcccagcaggggtggtgggggaagggggtcttctgaccttttcttcctctgagtcgaacctccccaacttcctgcagccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggc

SEQ ID NO: 18672 - DNA, 436 bp, Homo sapiens
aatctaggttttgctctccaaatggtagaagcaaccagaaataatgtaattaaagttttgaaactgtaaattatctagcatcttggcctacttcaatatactttatctgattatgtacttcactgcataattttattctatttaccactttacaattttactgccactaatgtacaaaaaatcaacacagaaacatatgatatggacgtatcacattctttatcagcctaagaacaaaagttagattaaaattagaatggataattagaatacctgctgcttaaacagatggtgaaaaaactttggaaaagctggatctgatgctaacggatggctaatgatggaggagcaacttcacttattttatgtacagaaaggaagatggttggtatctgtgcattaaaaatccaccaggataatctaaaaaaaaaaaaaa

SEQ ID NO: 18673 - DNA, 441 bp, Homo sapiens
atctaggttttgctctccaaatggtagaagcaaccagaaataatgtaattaaagttttgaaactgtaaattatctagcatcttggcctacttcaatatactttatctgattatgtacttcactgcataattttattctatttaccactttacaattttactgccactaatgtacaaaaaatcaacacagaaacatatgatatggacgtatcacattctttatcagcctaagaacaaaagttagattaaaattagaatggataattagaatacctgctgcttaaacagatggtgaaaaaactttggaaaagctggatctgatgctaacggatggctaatgatggaggagcaacttcacttattttatgtacagaaaggaagatggttggtatctgtgcattaaaaatccaccaggataatctaaaaaaaaaaaaaawtgsga

SEQ ID NO: 18674 - DNA, 270 bp, Homo sapiens
gactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcycgacgagcttgttttgtcccggactcggtgcccctgtagacaatggccctcgtgtctgccgattcccgcattgcagaacttctcacagagctccatcagctgatcaaacaaacccaggaagagcgttcgcg

SEQ ID NO: 18675 - DNA, 493 bp, Homo sapiens
tcttgccaaatcagactcaaagacttctcatttgaacctgaaatggacactaattcatcttcttattaacatgcttgtaacttctggtactcccttggaaagcttttggagaagatccaacttcatgttgctactaacacaagcaagtttataccacgagatatgtatcctgttacagtaacatgaatacatgtcaattataattcccagtgcttaggtttatgtttttataattgtccccaatcacaaccattccttgtcttatacagaatttaaaaaactttgtatctattattctatagatgattggtctccctgtgtcaaagttttacaaataactggtttggatgttttctcctcatttttctgcctacctatatgttcagccagacataagacttcattgattctttcctgcacagatttaattaccaccagttccttctctgaataacatagtttgttcaaagaacatctcctgggtaatgtacat

SEQ ID NO: 18676 - DNA, 179 bp, Homo sapiens
cgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagac

SEQ ID NO: 18677 - DNA, 405 bp, Homo sapiens
ctggacagagcacagaattgcttcttaagtcagcccggcgcggttgcaatagacagcaaaaaggtaaacgtttgcctgaaatccgcacgccagctccaccgccccgcccgatggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaaggtgtgtgactgtaggatgaggctttttgaaagatgaagtacgacactttgagaaagtgtttggaaagaaactggctgatgtcgaatggaaatctgaacattcacagatttcttttcctagatatagaaacgcaaaagc

SEQ ID NO: 18678 - DNA, 357 bp, Homo sapiens
  misc_feature 343: n=a, g, c or t
aattggggccgtaccatggcggagaagactcaaaagagtgtgaagattgctcctggagcagttgtatgtgtagaaagtgaaatcagaggagatgtaactatcggtaagaaatagtttatttactgtttttcaagaattgatgtgatttaatctattttagtgctttacaattagataccgtcttccatgtttatttcactgatgtcctagttttattgacaaaataatgcattttctcctatgtgtttaaattttctgaaagaatgtagtgtgatggaggctgtgtttaaactcctatctgagatactaatgaggctgtataacaaagtcattcatgtatttnaagagagatctgtt

SEQ ID NO: 18679 - DNA, 474 bp, Homo sapiens
  misc_feature 342,404,449: n=a, g, c or t
aagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactatacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatngactgggggacttacacattcccaaatgggcaaagtatactgggaaatttcaatgaaaatanggtggaaggtgaaggggcatatactgatatccaaggactagaatngagttgtaactttcattttacagct

SEQ ID NO: 18680 - DNA, 498 bp, Homo sapiens
gaaacgttaacgatgcccctacagatttaggagtaacaaggcggctctcacgagatgctagacagatcaaacagaaaggtggatatttggaaagaacagtcttctcccactgatgaggtaaacctcgagaccaatccagaaataaattgccaagcttctatcaaataattcaaaakgagacccaggactcttgatgatacacttgaagtcactaaatatgaaagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaactctgtattgtaacccgatccccaaggtgattctagtgtacattaaagtgtgagagtcttgt

SEQ ID NO: 18681 - DNA, 501 bp, Homo sapiens
gaaaacgttaacgatgcccctacagatttaggagtaacaaggcggctctcacgagatgctagacagatcaaacagaaaggtggatatttggaaagaacagtcttctcccactgatgaggtaaacctcgagaccaatccagaaataaatacattaatgcgagaagacacctttcctgaaatttgttttatgtttgcaatattttaaaaaacttttcaaacagatttttacacttcacaggggactcatggctgtgatagaaaacccaagtgagatatggatacgttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatgg

SEQ ID NO: 18682 - DNA, 458 bp, Homo sapiens
tttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaacccatctctactaaaaatacaaaaattagcctggcgtggtggtgtgcgcctgtaatcctagctactcgggaggctgaggcaggagtattgcttgaacctgggaggtggaggttacaatgagccaagattgtg

SEQ ID NO: 18683 - DNA, 377 bp, Homo sapiens
tttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcccaaaaaaaaaaaaaaaaaggc

SEQ ID NO: 18684 - DNA, 354 bp, Homo sapiens
tttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggagaadactttt

SEQ ID NO: 18685 - DNA, 509 bp, Homo sapiens
tactctgtgcggtggagcgaccctggataacagctccagggacactccttgctcaagacgctggggttagacgtgctccggctacacagcggagtgtcagggggccaagaatatccctctcctttttcttccctcctgctggctttggttgctttcctaaacattgccccaggcggcaaagtcggcttcactcttagcccttgttagggaaacgctggatccaagattagctgcgcccttctttgcttcagttgaacaagcaccagagtcgctgatttggcagtgtcggagcgggaggaactggtcttaaaaaggtacctcctgaactcgggaagactgctaaccctccagattattgttttgcatctgtgtgctgttcatgaacatacctcagagctgctcactgcaacttgaaatttcattatatttttaatcacaaagtttgcatcctacccttgatacatctgtgtttccttgacaaaaagagacaaactctgtaaaataaaaaa

SEQ ID NO: 18686 - DNA, 360 bp, Homo sapiens
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacat

SEQ ID NO: 18687 - DNA, 510 bp, Homo sapiens
agacgctgtgttctaggcaagggggatacacctgatggaagaaggtccttccctagacgtagctaacatcccagtgtgggagatgacacgaaacaagtatggtggaaatgatgtcacgcccactccaggcctaacctctaggaggactggcagtttctgctatggcctctgggagccatgagctgccatgaaaaaggtcaaactactctgctggagacacccacctggagaagccctgggattccatggagaggcagacggacccagctgagctcagtgttccagccatccccacgaaagcaccaggaacctgagtgaaaccatctcgatcctccagcatagcacaatcagcagctgaagatcactgagtgactctagtcggcgctccatggatcactgaaggatcacccagctgagccctgcgcaaatttctgactcacaaaactgtagacgatacaattgggttgttgtttgggggcagtttgttatgctgtagcaataaatagccag

SEQ ID NO: 18688 - DNA, 503 bp, Homo sapiens
gtagctgaggcccacggtttggagttaggtccctgcaccgccacctactatgaccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcagtgaaggcttggacaagtaatcagcacagtgcctcttacgtcatcgcctccaaaacctcagagcccagcatgcactggagacccggccctgccctgtgggtgctcccggaagcaggggatgcaggagccctcccacacctcctccttacctgccggagtgaagcggtcaggaggagggccggcggcttctctccttgttcagagcccgggcacagagccctagaggtgcattccaggtgcctagatgtccactcactgcctgtgaagccccgaagccactgggtcattggta

SEQ ID NO: 18689 - DNA, 399 bp, Homo sapiens
  misc_feature 288,375: n=a, g, c or t
aagaaaaggaccatccgttcatccaagatcatctcacctcccatgaagggaacggtcttctaaatgcagttttccttccagcagggtggatggggagcatcgctggctgacaggctggtcagaaaatgtgatgttctgratcgtggattttcaggttacaataccaggtgggccaaaattatccttccaagattaatcaggaaaggaaacagtttggacatcccagtagcagttacaattttctttggggccaatgacagtgcactaaaagatgagaatcccaagcancacattcccctggaggagtacgctgcgaacctaaagagcatggtgcagtacctgaagtccgttgacatccctgagaatcgagtcatnctcatcacgccgaccccactttgt

SEQ ID NO: 18690 - DNA, 368 bp, Homo sapiens
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaakgacaatttaaggataatatgtttcatggacttgggacttacacattcccaaat

SEQ ID NO: 18691 - DNA, 70 bp, Homo sapiens
acccactggctgctctgaaaagccatcttkcacattgttcctcatccgcctccttgctcgccgtaaccac

SEQ ID NO: 18692 - DNA, 373 bp, Homo sapiens
agcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaa

SEQ ID NO: 18693 - DNA, 355 bp, Homo sapiens
  misc_feature 73: n=a, g, c or t
actgggctgctctgaaaagccatttttgcattgttcctcatccgcctccttgcccgccgcagtcgcctccgcngcgcgcctmctccgccgccgcgactccggcagctttatcgccagagtccctgaactctcgctgttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggt

SEQ ID NO: 18694 - DNA, 337 bp, Homo sapiens
  misc_feature 236,268: n=a, g, c or t
actggctgctctgaaaagccatctttgcattgttcctcatccgcctccttgctcgcsgcagccgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaanaaggaagttgtggaagaggcagaaaatggaanakacgcccctgctaacgggaatgctaatgaggaaaatggggatcaggaggctgacaatgaggtagacga

SEQ ID NO: 18695 - DNA, 81 bp, Homo sapiens
ccccactggctgctctgaaaagccatctttgcattgttcctcatccgcctccttgctcgccgcagcckcctccgccgcggm

SEQ ID NO: 18696 - DNA, 161 bp, Homo sapiens
actggctgctctgaaaagccatctttgcattgttcctcatccgcctccttgcccgccgcagtcgcctccgccgcgscctcctccgccgccgcgaactccggcagctttatcgccagagtccctgaactctcgctttctttttarkcccctgcatcggatca

SEQ ID NO: 18697 - DNA, 302 bp, Homo sapiens
  misc_feature 40: n=a, g, c or t
attgttcctcatccgcctccttgctcgccgcagccgcctncgccgcgcgvctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaaacgggaatgctaatgaggaaaatggggagcaggaggctgacaatgag

SEQ ID NO: 18698 - DNA, 51 bp, Homo sapiens
ctggctgctctgaaaagccatctttgcattgttcctcatcctccttgctcg

SEQ ID NO: 18699 - DNA, 79 bp, Homo sapiens
ccactggctgctctgaaaagccatctttgcattgttcctcatccgcctccttgctcgccgcagccgcctccgccgcgcg

SEQ ID NO: 18700 - DNA, 242 bp, Homo sapiens
attttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtaaaaaaaaaaa

SEQ ID NO: 18701 - DNA, 393 bp, Homo sapiens
  misc_feature 171: n=a, g, c or t
tytggctgctctgaaaagccatctttgcattgttcctcatccgcctccttgctcgcygcagccgcctccgccgcgygcctcctscgssygccgcgactccgcagctttatcgccagagtccctgaactctcgctttctttttaatcccctgcatcggatcaccggcgtgcnccaccatgtcagacgcagccgtagacaccagctccgaaatcaccaccaaggacttaagggaggaagaggaggaggaagaagaaggtgatggtgaggdagaggatggagatgaagatgaggaagctgagtcagctacgggcaagcbggcagctgaagatgatgaggatgacgatgtcgataccaagrwgcagaagaccgacgargatgactagacagcataar

SEQ ID NO: 18702 - DNA, 71 bp, Homo sapiens
actggctgctctgaaaagccatctttgcattgttcctcatccgcctccttgctcgccgcagccgcctccgc

SEQ ID NO: 18703 - DNA, 69 bp, Homo sapiens
atctggctgctctgaaaagccatctttgcattgttcctcatccgcctccttgctcgccgcagccgcctc

SEQ ID NO: 18704 - DNA, 476 bp, Homo sapiens
  misc_feature 81: n=a, g, c or t
actggctgctctgaaaagccatctttgcattgttcctcatccgcctccttgctcgcsgcagccgcctccgcsgcgcgcctndtccaccgccgcggactccggcagctttatcgccagagtccctgaactctcgctttctttttaatcccctgcatcggatcaccggcgtgccccascatgtcagacgcagccgtagacaccagctccgaaatcaccaccaaggacaaaggagaagaaggaagttgtggaagaggcagaaaatggaagagacgccccggctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgata

SEQ ID NO: 18705 - DNA, 61 bp, Homo sapiens
cccccactggctgctctgaaaagccatctttgcattgttcctcatccgcctccttgctcgc

SEQ ID NO: 18706 - DNA, 525 bp, Homo sapiens
gttttctgcgcttccttctccctctctccagacgtcgtggtcgttcggtcctatgtcgcgccgggccctccggaagctgaagggggraacagcgcgggccaggagcccctcgggcccggcgccttgcatttcgatctccgtgatgacgatgacgcggaagaagaagggcccaagcgggagcttggtgtccggcgtcccgggggcgaagggaaggagggcgtccgagtcaacaaccgcttcgagctgataaacattgacgatcttgaggatgaccctgtggtgaacggggagaggtctggctgtgcgctcacagacgctgtgggrkaaagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggat

SEQ ID NO: 18707 - DNA, 203 bp, Homo sapiens
  misc_feature 81..82: n=a, g, c or t
tctggctgctctgaaaagccatctttgcattgttcctcatccgcctccttgctcgccgcagccgcctccgccgcgcgccknntccgccgccgcgactccggcagctttatcgccagagtccctgaactctcgctttctttttaatcccctgcatcggatcaccggcgtgccccaccatgtcagacgcagccgtagacaccagc

SEQ ID NO: 18708 - DNA, 67 bp, Homo sapiens
tctggctgctctgaaaagccatctttgcattgttcctcatccgcctccttgctcgccgcagccgcct

SEQ ID NO: 18709 - DNA, 487 bp, Homo sapiens
  misc_feature 80..81,298: n=a, g, c or t
actggctgctctgaaaagccatctttgcattgttcctcatccgcctccttgctcgccgcagccgcctcggccgcgsgccnntccgccgccgcgactccggcagctttatcgccagagtccctgaactctcgctttctttttaatcccctgcatcggatcaccggcgtgccccacmatgtcagacgcagccgtagacaccagctccgaaatcaccaccaaggacttaaaggagaagaaggaagttgtggaagaggcagaaaatggaagagacgcccctgctaacgggaatgctaatganggaaaatggggagcaggaggctgacaatgaggtagacgaagaagaggaagaaggtggggaggaagaggmggaggaacgaagaaggtgatggtgaggaagaggatggagatgaagatgaggaagctgagtcagctacggggcaagccgggcagctgaagatgatgaggatgacgatgtcgataccaagaa

SEQ ID NO: 18710 - DNA, 236 bp, Homo sapiens
  misc_feature 82: n=a, g, c or t
actggctgctctgaaaagccatctttgcattgttcctcatccgcctccttgctcgccgcagccgcctccgccgcgcgcctyntccgccgccgcgactccggcagctttatcgccagagtccctgaactctcgctsttctttttaatccccctgcatcggatcaccggcgtgcsccamcatgtcagacgcagcsgtagacaccagctccgaaatcaccaccaaggactyaaaggaga

SEQ ID NO: 18711 - DNA, 427 bp, Homo sapiens
  misc_feature 72,215,229: n=a, g, c or t
actggctgctctgaaaagccatctttgcattgttcctcatccgcctccttgcccgccgcagtcgcctccgsngcgcgcctmmtccgccgccgcgactccggcagctttatcgccagagtccctgaactctcgctttctttttaatcccctgcatcggatcaccggcgtgccccaccatgtcagacgcagscgtagacaccagctccgaaatcaynaccaaggacttaankvgagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggagctgagtc

SEQ ID NO: 18712 - DNA, 68 bp, Homo sapiens
tctggctgctctgaaaagccatctttgcattgttcctcatccgcctccttgctcgccgcagccgcctc

SEQ ID NO: 18713 - DNA, 62 bp, Homo sapiens
cccccactggctgctctgbaaaagccatctttgcattgttcctcatccgcctccttgctcgc

SEQ ID NO: 18714 - DNA, 67 bp, Homo sapiens
actggctgctctgaaaagccatctttgcattgttcctcatccgcctccttgctcgccgcagccgcct

SEQ ID NO: 18715 - DNA, 204 bp, Homo sapiens
  misc_feature 185: n=a, g, c or t
actggctgctctgaaaagccatctttgcattgttcctcatccgcstccttgcscgcsgcagtcgcctccgccgcgcgcctcctccgccgccgcgactccggcagctttatcgccagagtccctgaactctcgctttctttttaatcccctgcatcggatsaccggcgtgccccaccatgtcagangcagcsgtagacaccagct

SEQ ID NO: 18716 - DNA, 314 bp, Homo sapiens
  misc_feature 85: n=a, g, c or t
ccccactggctgctctgaaaagccatctttgcattgttcctcatccgcctccttgctcgcsgcagccgcctccgccgcgcgcctnvtccgccgccgcgactccggcagctttatcgccagagtccctgaactctcgstttctttttaatcccctgcatcggatcaccggcgtgccccaccatgtcagacgcagccgtagacaccagctccgaaatcaccaccaasgacttaaaggagaagaaggaasttgtggaggcagaaaatggaagagacgcccctgctaacgggaatgctaatgaggaaaatggggagca

SEQ ID NO: 18717 - DNA, 337 bp, Homo sapiens
  misc_feature 82: n=a, g, c or t
actggctgctctgaaaagccatctttgcattgttcctcatccgcctccttgctcgccgcagccgcctccgcsgcgcgccttntccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacga

SEQ ID NO: 18718 - DNA, 62 bp, Homo sapiens
  misc_feature 19: n=a, g, c or t
ccccactggctgctctdrnaagccatcttttcattgttcctcacccgcctccttgctcgcsg

SEQ ID NO: 18719 - DNA, 69 bp, Homo sapiens
ccccactggctgctctgaaaagccatctttgcattgttcctcatccgcctccttgctcgcsgcagccgc

SEQ ID NO: 18720 - DNA, 235 bp, Homo sapiens
cccccactggctgctctgaaaagccatctttgcattgytcctcatccgcctccttgctcgccgyagccgmctccgccgcgcgcctcctccgccgccgcggactmcggcagctttatcghcagagtccctgaactctcgctttctttwkaatcccctgcatmggatcaccggcgtgccccaccatgtcagacgcadccgymkacaccagctscgaaatcaccaccaaggacttaaa

SEQ ID NO: 18721 - DNA, 341 bp, Homo sapiens
agtggtttgcgttttcaagatggcgactccctatgttactgacgagaccggcggggtgggaacgccaaacctctcccttctttttgacttcacccttggataccatcaaggccagaggatggaaccaagataacataaaataggtgctcctttgtgataatgggctatttgtatctctgagggcttccacacaggatggccattcaagaagcttctgctctgcctttcattacagtctatctttagtcctcctaaaccttcagctataatctctatgcaatcaacttaaatatatgtttgtagtattgtccctttctcccaaattccatgtaaaacacttg

SEQ ID NO: 18722 - DNA, 203 bp, Homo sapiens
tctggctgctctgaaaagccatctttgcattgttcctcatccgcctccttgctcgccgcagccgcctccgscgcgcgccthhtccgccgccgcgactccggcagctttatcgccagagtccctgaactctcgctttctttttaatcccctgcatcggatcaccggcgtgccccaccatgtcagacgcagccgtagacaccagc

SEQ ID NO: 18723 - DNA, 67 bp, Homo sapiens; identical to SEQ ID NO: 18714

SEQ ID NO: 18724 - DNA, 202 bp, Homo sapiens
  misc_feature 81: n=a, g, c or t
tctggctgctctgaaaagccatctttgcattgttcctcatccgcctccttgctcgccgcagccgcctccgccgcgcgcctntccgccgccgcgactccggcagctttatcgccagagtccctgaactctcgctttctttttaatcccctgcatcggatcaccggcgtgccccaccatgtcagacgcagccgtagacaccagc

SEQ ID NO: 18725 - DNA, 260 bp, Homo sapiens
tctggctgctctgaaaagccatctttgcattgttcctcatccgcctccttgctcgcsgcagccgcctssgcsgcgcgsstcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaa

SEQ ID NO: 18726 - DNA, 486 bp, Homo sapiens
  misc_feature 174,193: n=a, g, c or t
agatggcgactccctatgttactgacgagaccggcggcaagtatatcgcgtcaacacagcgacctgacgggacctggcgcaasagcggagggtgaaagaaggatatgtgccccaggaggaggtcccagtatatgawaacaagtatgtgaagtttttcaagagtaaaccagagtngcccccagggctaavcmtnaggccactgacwcctgtmaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggca

SEQ ID NO: 18727 - DNA, 210 bp, Homo sapiens
ccccactggctgctctgaaaagccatctttgcattgttcctcatccgcctccttgcccgccgcagtcgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctcc

SEQ ID NO: 18728 - DNA, 361 bp, Homo sapiens
actggctgctctgaaaagccatctttgcattgttcctcatccgcctccttgcccgccgcagtcgcctccgccgcgcgcctcctccgccgccgcgaactccggcagctttatcgccagagtccctgaactctcgctttctttttaatcccctgcatcggatcaccggcgtgcccacaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggag

SEQ ID NO: 18729 - DNA, 67 bp, Homo sapiens
cactggctgctctgaaaagccatctttgcattgttcctcatccgcctccttgctcgccgcagccgcc

SEQ ID NO: 18730 - DNA, 63 bp, Homo sapiens
  misc_feature 13: n=a, g, c or t
stggstgctctgnaaagccatctttgcattgttcctcatscgsctccttgctcgccgcagccg

SEQ ID NO: 18731 - DNA, 403 bp, Homo sapiens
actggctgctctgaaaagccatctttgcattgttcctcatccgcctccttgctcgccgcagccgcctccgccgcgcgcctcctccaccgccgcggactccggcagctttatcgccagagtccctgaactctcgctttctttttaatcccctgcatcggatcaccggcgtgccccaccatgtcagacgcagccgtagacaccagctccgaaatcaccaccaaggacaaaggagaagaaggaagttgtggaagaggcagaaaatggaagagacgccccggctaacgggaatgctaatgaggaaaatggggagcaggaggctgacaatgaggtagacgaagaagaggaagaaggtggggaggaagaggaggaggaagaagaaggtgatggtgaggaagaggatgga

SEQ ID NO: 18732 - DNA, 70 bp, Homo sapiens
tctggctgctctgaaaagccatctttgcattgttcctcatccgcctccttgctcgccgcagccgcctcsg

SEQ ID NO: 18733 - DNA, 63 bp, Homo sapiens
  misc_feature 18..19: n=a, g, c or t
cccccastggstgctctnnaaagccatctttgcattgttcctcatccgcctccttgcccgccg

SEQ ID NO: 18734 - DNA, 70 bp, Homo sapiens
actggctgctctgaaaagccatctttgcattgttcctcatccgcctccttgctcgcsgcagccgcctcyg

SEQ ID NO: 18735 - DNA, 374 bp, Homo sapiens
attttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaaaaaaaaaaaaaaagg

SEQ ID NO: 18736 - DNA, 384 bp, Homo sapiens
  misc_feature 72,235..237,263..264: n=a, g, c or t
ccccactggctgctctgaaaagccatctttgcattgttcctcatccgcctccttgctcgccgcagccgcctncgccgcgcrmctcctccgccgccgcggactccggcagctttatcgccagagtccctgaactctcgctttctttttaatcccctgcatcggatcaccgggcgtgccccaccatgtcagacgcagccgtagacaccagctccgaaatcaccaccaaggacttavnnnmgaagaaggaagttgtggaggcagmnnatggaagagacgcccctgctaacgggaatgctaatgaggaaaatggggagcaggaggctgacaatgaggtagacgaagaagaggaagaaggtggggaggaagaggaggaggaagaagaag

SEQ ID NO: 18737 - DNA, 313 bp, Homo sapiens
actggctgctctgaaaagccatctttgcattgttcctcatccgcctccttgctcgccgcagccgcctmmgccgcgcgcctcctccgccgccgsgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagca

SEQ ID NO: 18738 - DNA, 253 bp, Homo sapiens
actggctgctctgaaaagccatctttgcattgttcctcatccgcctccttgctcgccgcagccgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaaga

SEQ ID NO: 18739 - DNA, 68 bp, Homo sapiens
actggctgctctgaaaagccatctttgcattgttcctcatccgcctccttgctcgccgcagccgcctc

SEQ ID NO: 18740 - DNA, 406 bp, Homo sapiens
attttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgccccattgtgtcktaaagaaatagtatctagaatcagacagatttctcatgaaatatgagaaatctgtctgattctagatactatttctttatttcatgacacatgtgaagaggcatcgtggacttttttctactcaattccagccaatgttgaaaaaaaaa

SEQ ID NO: 18741 - DNA, 253 bp, Homo sapiens; identical to SEQ ID NO: 18738

SEQ ID NO: 18742 - DNA, 63 bp, Homo sapiens
cccccactggctgctctgaaaagccatctttgcattgttcctcatccgsctccttgctcgccg

SEQ ID NO: 18743 - DNA, 255 bp, Homo sapiens
attttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtaaaaaaaaaaaaaaaaaaaaaaaa

SEQ ID NO: 18744 - DNA, 331 bp, Homo sapiens
actggctgctctgaaaagccatctttgcattgttcctcatccgcctccttgctcgccgcagccgcctccgccgcgcgcctcctccgccgcccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgag

SEQ ID NO: 18745 - DNA, 289 bp, Homo sapiens
ccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaggcagaaaatggaagagacgcccctgctaacggg

SEQ ID NO: 18746 - DNA, 202 bp, Homo sapiens
  misc_feature 81: n=a, g, c or t
tctggctgctctgaaaagccatctttgcattgttcctcatccgcctccttgctcgccgcagccgcctccgccgcgcgcckntccgccgccgcgactccggcagctttatcgccagagtccctgaactctcgctttctttttaatcccctgcatcggatcaccggcgtgccccaccatgtcagacgcagccgtagacaccagc

SEQ ID NO: 18747 - DNA, 51 bp, Homo sapiens
  misc_feature 38: n=a, g, c or t
actggctgstctgaaaagccatctttgcattgttcmtnatmcgcctccttg

SEQ ID NO: 18748 - DNA, 64 bp, Homo sapiens
actggctgctctgaaaagccatctttgcattgttcctcatccgcctccttgctcgccgsagccg

SEQ ID NO: 18749 - DNA, 431 bp, Homo sapiens
agttgatgcagtttcttcatagcgtcgatggtcttcacaatttggtatgtttttgcagtggctggtacttgtttttcctttccgtatttagtgcttccttgaggagctcttgtaaggcaggcctggtggtgacaaaatctctcagcatttgcttatctgtaaaggattttattgctccttcacttatgaagcttagtttggctggagatgaaattctaggttaaaaattcttttattcccactggctgctctgaaaagccatctttgcattgttcctcgtccgcctccttgctcgcggcacctccttgctcgcggcasctccttgctcgccgcagccgcctccgccacgcgcctcctccgccgccgcgmctccggcagctttatcgccagagtccctgaactctcgctttctttttaatcgcctgcatcgg

SEQ ID NO: 18750 - DNA, 247 bp, Homo sapiens
  misc_feature 68,77: n=a, g, c or t
actggctgctctgaaaagccatctttgcattgttcctcatccgcctccttgctcgccgsagccgsggnsgssgcggnstcctccgccgccgcgactccggcagctttatcgccagagtccctgaactctcgctttctttttaatcccctgcatcggatcaccggcgtgccccaccatgtcagacgcagccgtagacaccagctccgaaatcaccaccaagtacttaaaggagaagaaggaagttgtk

SEQ ID NO: 18751 - DNA, 68 bp, Homo sapiens; identical to SEQ ID NO: 18739

SEQ ID NO: 18752 - DNA, 365 bp, Homo sapiens
atttgcaaccttsgccatctgtccagaacctgctcccacctcaggcccaggccaaccgtgcactgctgcaatgggctctgagctggagacggcgatggagaccctcatcaacgtrttccagcccactcgggcaaagagggggacaagtacaagctgagaaagarggagctgmaagagmtgctgcagacggagctctctggsttcctggatgtgaagagcttatgctgtaggcaacagaagccctcaagacttttgaggaggcctagaagagtccsataattcaatgcagttcctctcgctcatctttgcctcctgstcctcaaccacccccttgcmtctgactcagtgctgtacccttccctata

SEQ ID NO: 18753 - DNA, 50 bp, Homo sapiens
tctggctgctctgaaaascsatctttgsattgttcctcatccgcctcctt

SEQ ID NO: 18754 - DNA, 319 bp, Homo sapiens
tctgggtgctctgaaaagccatctttgcattgttcctcatccgcctccttgctcgccgcagccgcctccgccgcgcgcctcctccgccgccgcggactccggcagctttattcgscagagtccctgaactctcgctttctttttaatcccctgcatcggatcaccggcgtgccccaccatgtcagacgcagccgtagacacsagctccgaaatcaccaccaaggacttaaaggagaagaaggaagttgtggaagaggcagaaaatggaagagacgcccctgctaacgggaatgctaatgaggaaaatggggagcaggag

SEQ ID NO: 18755 - DNA, 64 bp, Homo sapiens
actggctgctctgaaaagccatctttgcattgttcctcatccgcctccttgctcgccgcagccg

SEQ ID NO: 18756 - DNA, 386 bp, Homo sapiens
aatcccctcgaccgctcgcgtcgcatttggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggtgaaaataaatagggaagatggagacaccctctggggtcctctctgagtcaaatccagtggtgggtaattgtacaataaattttttttggtcaaattcaaaaaaaaaaaaaaaaaa

SEQ ID NO: 18757 - DNA, 464 bp, Homo sapiens
  misc_feature 173,258: n=a, g, c or t
actggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgchncaccatgtcagacgcagccgtagacaccagctycggraattmacaaccarggmcttaaaggagaagaaggaagttgtggaaaayncagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgag

SEQ ID NO: 18758 - DNA, 219 bp, Homo sapiens
actggctgctctgaaaagccatctttgcattgttcctcatccgcctccttgcccgccgcagtsgcctccgcsgcgcgcctcctccgccgccgsgactccggcagctttatcgccagagtccctgaactctcgctttctttttaatcccctgcatcggatcaccggcgtgccccaccatgtcagacgcagccgtagacaccagctccgaaatcaccacca

SEQ ID NO: 18759 - DNA, 426 bp, Homo sapiens
atataaggccagtmggactgcgacacarcmcatcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggacctttttgatctacaatgaagccctcaagggctgawaaataaatagggaagatggagacaccctctggggtcctctctgagtcaaatccagtggtgggtaattgtacaataaattttttttggtcaaatctaaaaaaaaaaaaaaaaaag

SEQ ID NO: 18760 - DNA, 461 bp, Homo sapiens
cccactggstgctctgaaaagccatctttgcattgttcctcatccgcctccttgctcgccgcagccgcctccgccgctcgcctcctmcgccgccgcgactccggcagctttatcgcmcagartccctgaactctcgctttctttttaatcccctgcatcggatcaccggcgtgccccascatrtcagacgcagccgtaraacaccagctccgaaatcaccaccaaggacttaaaggagaagaatgaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtcgatgstgaggaagaggatggagatgaagatgaggaagctgagtcagctacgggcaagcgggcagctgaagat

SEQ ID NO: 18761 - DNA, 70 bp, Homo sapiens
actggctgctctgaaaagccatctttgcattgttcctcatccgcctccttgctcgcsgcagccgcctcsg

SEQ ID NO: 18762 - DNA, 487 bp, Homo sapiens
actggctgctctgaaaagccatctttgcattgttcctcatccgcctccttgcccgccgcagtcgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcacsaccaaggacttaaaggagaagaaggaagttgtaggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtsgatggtsaggaagaggatggagatgaagatgaggaagctgagtcagctacgggcaagcgggcagctgaagatgatgaggatgacgatgtcgataccaag

SEQ ID NO: 18763 - DNA, 405 bp, Homo sapiens
atcccctcgaccgctcgcgtcgcattttggccgcctccctaccggccctctgctgccagctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatc

SEQ ID NO: 18764 - DNA, 359 bp, Homo sapiens
tctggctgctctgaaaagccatctttgcattgttcctcatccgcctccttgctcgccgcagccgcctccgssgcgcgcctsctccgccgccgcgactccggcagctttatcgccagagtccctgaactctcgctttctttttaatcccctgcatcggatcaccggcgtgccccadvcatgtcagacgcagccgtagacaccagctccgaaatcaccaccaaggacttaaaggagaagaaggaagttgtggaagaggcagaaaatggaagagacgcccctgctaacgggaatgctaatgaggaaaaatggggagcaggaggctgacaatgaggtagacgagaagaggaagaaggtgggga

SEQ ID NO: 18765 - DNA, 376 bp, Homo sapiens
  misc_feature 175,256..257,284..285: n=a, g, c or t
ccccactggctgctctgaaaagccatctttgcattgttcctcatccgcctccttgctcgcmgcagccgcctccgccgcgcgcctcctccgccgccgcggactccggcagcwttatcgccagagtccctgaactctcgctttctttttaatcccctgcatcggatcaccggcgtgnhccaccatgtcagacgcagccgtagacaccagctccgaaatcaccaccaaggacttaaaggagaagaaggaagttgtgganncagaaaatggaagagacgccctgcybnnygggaatgctaatgaggaaaatggggagcaggaggctgacaatgaggtagacgaagaagaggaagaaggtggggaggaagaggaggaggaa

SEQ ID NO: 18766 - DNA, 414 bp, Homo sapiens
atcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctggggtcctctctgagtcaaatccagtggtgggtaattgtacataaatt

SEQ ID NO: 18767 - DNA, 64 bp, Homo sapiens; identical to SEQ ID NO: 18755

SEQ ID NO: 18768 - DNA, 68 bp, Homo sapiens
actggctgctctgaaaagccatctttgcattgttcctcatccgcctccttgctcgccgsagccgcctc

SEQ ID NO: 18769 - DNA, 404 bp, Homo sapiens
ccccactggctgctctgaaaagccatctttgcattgttcctcatccgcctccttgcccgccgcagtcgcctccgccgcgcgcctcctccgccgccgcggactccggcagctttatcgccagagtccctgaactctcgctttctttttaatcccctgcatcggatcaccggcgtgccccaccatgtcagacgcagcagacaccagctccgaaatcaaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaatgtgatggtgaggaagaa

SEQ ID NO: 18770 - DNA, 59 bp, Homo sapiens
gaaaaaaaagccatctttgcattgttcctcatccgcctccttgctcgccgsagccgcct

SEQ ID NO: 18771 - DNA, 362 bp, Homo sapiens
  misc_feature 111,175,263: n=a, g, c or t
ccccactggctgctctgaaaagccatctttgcattgttcctcatccgcctccttgctcgccgcagccgsctccggcgcgsgcctcctccgccgccgcggactccggcagcnttatcgccagagtccctgaactctcgctttctttttaatcccctgcatcggatcaccggcgtgncccaccatgtcagacgcagccgtagacaccagctccgaaatcaccaccaaggacttaaaggagaagaaggaagttgtgvaggcavkwntmtggaagagacgcccctgctaacgggaatgctaatgaggaaaatggggagcaggaggctgacaatgaggtagacgaagaagaggaagaaggtggggag

SEQ ID NO: 18772 - DNA, 521 bp, Homo sapiens
cccactggctgctctgaaaagccatctttgcattgttcctcatccgcctccttgctcgccgcagccgcctccgccgcgcgcctcttccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaaagggaagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaa

SEQ ID NO: 18773 - DNA, 457 bp, Homo sapiens
aatcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaargcttttyc

SEQ ID NO: 18774 - DNA, 339 bp, Homo sapiens
  misc_feature 81,180..181: n=a, g, c or t
cccccactggctgctctgataaagccatctttgcattgttcctcatccgcctccttgctcgccgcagccgsctycggcgsngbgccttcctccgccgccgcggactccggcagctttatcgccagagtccctgaactctcgctttctttttaatcccctgcatcggatcaccggcgtgcnncaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgagr

SEQ ID NO: 18775 - DNA, 71 bp, Homo sapiens
ccccactggctgctctgaaaagccatctttgcattgttcctcatccgcstccttgctcgcsgcagccgcct

SEQ ID NO: 18776 - DNA, 63 bp, Homo sapiens
cccccactggctgctctgaaaagccatctttgcattgttcctcatccgcctccttgctcgccg

SEQ ID NO: 18777 - DNA, 390 bp, Homo sapiens
tctggctgctctgaaaagccatctttgcattgttcctcatccgcctccttgctcgccgcagccgcctccgccgcgcgcstycctccgccgccgcgactccgcagctttatcgccagagtccctgaactctcgctttctttttaatcccctgcatcggatcaccggcgtgccccaccatgtcagacgcagccgtagacaccagctccgaaatcaccaccaaggacttaagggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaa

SEQ ID NO: 18778 - DNA, 253 bp, Homo sapiens
actggctgctctgaaaagccatctttgcattgttcctcatccgcctccttgctcgcsgcagccgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaaga

SEQ ID NO: 18779 - DNA, 390 bp, Homo sapiens
tcgaatcattgagttctttttaagggtctccccgattctctcaacttcaggcttttttctggccagtgccctggaaactataagcaatagtaaacgatccagggaggaatcccctgcgaaggaagcccagtggggctttgggacactagcacgtgtgagtaatcatacccagtgttgtatgaagtgtcttctcatacactggcatcccaggaagacagacggatggaacggatgttcttacttcatggaataaaagttttgctgactgcctgaggaaagctgagagcagggaatgaggtgccccggtgtggagggtcagggggagaatgtactcggggtgggtgctgacaggcaagaaggaggggactcctgttgagtagtaagtagctg

SEQ ID NO: 18780 - DNA, 346 bp, Homo sapiens
atcccctcgaccgctcgcgtcgcatttggccgcctccctaccgctccaagcccagccctcagccatggcatgccccctggatcaggccattggctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggscttggctttgatctacaatgaagccctcaagggctgaaaaataaata

SEQ ID NO: 18781 - DNA, 326 bp, Homo sapiens
tctggctgctctgaaaagccatctttgcattgttcctcatccgcctccttgctcgccgcagccgcskmmgccgcgkvctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatg

SEQ ID NO: 18782 - DNA, 219 bp, Homo sapiens
actggctgctctgaaaagccatctttgcattgttcctcatccgcctccttgcccgccgcagtcgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccacc

SEQ ID NO: 18783 - DNA, 260 bp, Homo sapiens
tctggctgctctgaaaagccatctttgcattgttcctcatccgcctccttgctcgcsgcagccgcctccgccgcgcgcstcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaa

SEQ ID NO: 18784 - DNA, 66 bp, Homo sapiens
actggctgctctgaaaagccatctttgcattgttcctcatccgcctccttgctcgccgtaaccacc

SEQ ID NO: 18785 - DNA, 156 bp, Homo sapiens
actggctgctctgaaaagccatctttgcattgttcctcatccgcctccttgctcgccgcagccgcctccgccgcgcgcctcctccgccgccgcgactccggcagchttatcgccagagtccctgaactctcgctttctttttaatcccctgcatcg

SEQ ID NO: 18786 - DNA, 67 bp, Homo sapiens
actggctgctctgaaaagccatctttgcattgttcctcatccgcctccttgctcgcsgcagccgcct

SEQ ID NO: 18787 - DNA, 67 bp, Homo sapiens; identical to SEQ ID NO: 18786

SEQ ID NO: 18788 - DNA, 229 bp, Homo sapiens
actggctgctctgaaaagccatctttgcattgttcctcatccgcctccttgcccgccgcagtcgcctccgccgcgcgcctcctccgccgccgcgactccggcagctttatcgccagagtccctgaactctcgctttctttttaatcccctgcatcggatcaccggcgtgccccaccatgtcagacgcagccgtagacacsagctccgaaatcaccaccaaggacttaaa

SEQ ID NO: 18789 - DNA, 435 bp, Homo sapiens
  misc_feature 350,396: n=a, g, c or t
atcccctcgaccgctcgcgtcgcatttggccgcctccctaccgctccaagcccagccctcagccatggcatgccccctggatcaggccattggctcctcgtggccatcttccacaagtactccggcakggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaaggstgaaartaaatagggaanatggagacaccctctggggtcctctctgagtcaaatccagtggtgnggtaatttgtacaataaattttthttggtcaattcaaag

SEQ ID NO: 18790 - DNA, 70 bp, Homo sapiens
cccccactggctgctctgaaaagccatctttgcattgttcctcatccgcctccttgctcgccgcagccgc

SEQ ID NO: 18791 - DNA, 527 bp, Homo sapiens
agagggagctgcccagcggcctcacgctgtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacaggttgtgcagtggtgggaggcatcagaccctgcgtgtctgtagtagggcttttctggaaggagtgtgtgtgtgtgtgtgtgtgtgcgtgcgcgtgtacgtgcatgcatgagccggagcaatcaccagcgcatgtgcctgtcggggagtcagtgggagggggctggtaggggaggtggggaagctgctgctaggtgaggggaactgcagggcctcagttgccaagtggctggtactatctgtcagctgtttgcaaa

SEQ ID NO: 18792 - DNA, 466 bp, Homo sapiens
gagtcggcgccatgaccccatcgaggcttccctggttgcttagctgggtctcggccacggcgtgagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtgtatgtgtttaaatatatatatat

SEQ ID NO: 18793 - DNA, 510 bp, Homo sapiens
ttctaagaatcctgtccccaaattaaaatgtctttaaagccccctaaaaaggtgttctagtgttctaataccattaacctaggaagtattggtgctttgttctggtagtgcatgcaatattacaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgcgcttctttacattattggtgcaatgaaagtatgggaaagtctcaacagwacagactggacatttgagaccttccatttttcaaaatttcag

SEQ ID NO: 18794 - DNA, 453 bp, Homo sapiens
tatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgt

SEQ ID NO: 18795 - DNA, 465 bp, Homo sapiens
ctttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgtkcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtctttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctcaattcc

SEQ ID NO: 18796 - DNA, 503 bp, Homo sapiens
ctttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgtkcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtctttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattccggagagaagattgtattttttacagttttttgggtttgg

SEQ ID NO: 18797 - DNA, 444 bp, Homo sapiens
  misc_feature 342: n=a, g, c or t
gcggaagtgttgcttactgggtcctgaatcggctgcgtgctgttctaggtggggacttgagagactgtagatgggtctagggagtggtcgaatataaataagctagattttttttttttttaattgcaagggaactccctaggaattccatccatggccttgtggaacgatctgccaaagaaaaaatatttatctctcctcgctgtgtcacccaggctggagtgaagaggtgcgatctcggctcactgsaacctccgcctcctggattcaagcatcagcctccctagaagctgggattatgggtgcmggcsatcacacctggctattatttgtacttttagnagagatggggtttcgcsatgttggccaggctggtctcgaacacctgacctcaagtgacgcacctgccttggcctcccaaagtgctgggattacaggcacggg

SEQ ID NO: 18798 - DNA, 482 bp, Homo sapiens
ctaatcgaaaataattaactaatctttgattaatttgcttaacctctataatcttaggtttcttcatcagtaaaatggaaatgataacaaagcctctggcccagggctgttgcctggatacaatttaggtaaagttctagcatagtgtctgacacatggtaagcactgaatagattctaatgtgttgattgatattcatctttttctaagatgctagaaattgcacacctttaccattgactattaaatgtgacatattcagtttaataggcaatgtgaaagaatgggttacatgtggtttaaccaaaaagtaacaacgtcatccctgatgttgtccatatgccatcacattcatctaataagtatcacaggttggtcattgcattgagaagcaggacccccattttggcacagagtgaccatctccacagtcacggccgttcctcagcctggcagttaagcacacaatcacgtctttctgt

SEQ ID NO: 18799 - DNA, 403 bp, Homo sapiens
aacacggaaagagctggcttgcgagctccctgcttaacagaaggctcagttgcccaagtgacgaaggcattgtggggcacgaaccaggctttggtgaatttatctcattatacaccaggagttataatttaaaaaccagtgtcatataaagaagaaaaaagatatggtgagatacaataccattaacacttcttcagaaacggattttaaagcagaacttccatgactgtgaaatccaaccgggtgcgcgaccacgaggaaggatggcgagggaggaaaccgcgctttgttgttgagcattcatcactatgagaaagacatacttgagctacccatttggtcctaaggaggatgaagcatgctgtgtgacagagacaaccagcagacatttgagccaggacag

SEQ ID NO: 18800 - DNA, 506 bp, Homo sapiens
cacagtgatttgttttgtttcttgtatatttcagtttgtattatgtaaaaagtaatagtgtatacatcagatttaaataataatttaaagcctttttctccgtgcctcctttatgttttttactcttaatccatttttcttttccatcattcttcaaatattaattaaatttaataatttatctaaaagcatatgtatttaaaaatatatttaaaagcataaaatacttttacagtgtaaaagaattatgtagggtgggtgtggtggctcacacctgtaatcccaacacttcaggaggctgaggcaggcggatcacctgaggtcaggagttcgagaccagcctggccagcctggtgaaacccgtctctattaaaaacacaaaaattggctgggcatggtggcgggcgtctgtagtcccagctacttgggagactgactcaggagaattgcttgaacccgggaggcggaggttgcagtgagccaagatcacacccactgcactcctg

SEQ ID NO: 18801 - DNA, 600 bp, Homo sapiens
cgaatacctcaactaagaaatgggagaggatgccagaaatagttggctaaaaagtaatatggcaagtatttagattgtacaagcaagcctttacagaaaatctaaatttcgaaaaattatattcaaaattatgcttgaagtataataaatcccaaaatatcaccttaaaacagtcatataaattaggatggcgcccacgggtctaggactaaggcagaacccatagccaatatttgtcggtkaagagacaaactgctgaatagagttagtacataaatttaggattacaaagttctaccttctaccagaacaactaggtcaaactgttcccactaacagattttccattcctcttttgcagtatcatgggctaaccaattcataatcgattttttaaaactttaacaggcccactatatgttaatcattgggttagggaacttatgaacaaaatatcaaaattctaagtaaagacaaaattagtattgccttaggctccaatatggcttggcaaggtactattactgattctatctttatttaaaatgtcaacattttgtttatcgtacatctttgcattgattttttaaatattgcatt

SEQ ID NO: 18802 - DNA, 499 bp, Homo sapiens
ttccgccgggctgctccgcgggcgcgtcggccatgagcgagttgccgggcgacgtgcgggcgtttctgcgggacacccgagcctgcgctccagacggacgcccgcaagtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggagaggaggagggaggaccagatggacggtgacgggcctcgccsccgggaagccttctggtagcccacatccagtgatg

SEQ ID NO: 18803 - DNA, 528 bp, Homo sapiens
cccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaagagatgctgctgacaaaccaagaggatttgccagaggtcttgatcctgaaagaataattggtgccacagacagcagtgggaga

SEQ ID NO: 18804 - DNA, 83 bp, Homo sapiens
  misc_feature 43: n=a, g, c or t
aaaaagtagacggcctggtaggtgctctagggataacccttcnmcccccactccaccccccttcccgcacacccatttagact

SEQ ID NO: 18805 - DNA, 490 bp, Homo sapiens
  misc_feature 86: n=a, g, c or t
caaaaaatgcctgacctcaggtgatccacccgcctcggcctcccaaagtgttcgaattacaggcgtgacaccacacccagcccggnwttattcttaaagtgacctggtgagccagctggtgtggagatgaggcgggaagcagggctgatggagtccctggacagtggatggcagtggcttggccaggccgctaacagcaggggcactgggaagtgattggattctagatactgatttcaagggtagcacacacgtgatctgctgatagattccatgtcaggtgtgagagggaggagagtcaagctcatccacagctctggcagcggaagacggccaaagtgaagaaggtggcctcaagtttacctccaccttccaaacctcaactggtaaaacctcatgcatgcccagaatgctagcacaagagatttagggaaatgtgggtattttgctttctggccctgcagttcaggttccaccttataaaatggga

SEQ ID NO: 18806 - DNA, 447 bp, Homo sapiens
gcagataggggtagcctggaggcctgcagtccgcgcggccgsggggagggacgagagggcctgacgtacagattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagc

SEQ ID NO: 18807 - DNA, 447 bp, Homo sapiens
caatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagc

SEQ ID NO: 18808 - DNA, 495 bp, Homo sapiens
ctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctcca

SEQ ID NO: 18809 - DNA, 384 bp, Homo sapiens
actcattgtgtctgtgtcgaggcgtcgggagggcctaagtccgtgtgcgtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatcgaggaagaccacatgtgggggcaggattccaccctacaggacacgcctcctccagacccagagatcattccg

SEQ ID NO: 18810 - DNA, 297 bp, Homo sapiens
ctttttaaatttatgccgacagaggaagaagctgatatttaacaaataacaagaggttgcgataaatagaatttaaggtgggaaagcagccgccaaactgacaaatcgtcttcgagaccgacaagaaaatagtagtccggaatttggctaatggatggagaaggtggtcgtttttcatagacccttacggagaatatctagtgaagctaaagagatcaccataaacttatgcattcaaacgcatttctggaacagaggtcgtaaccgattttgtttccatcatcagtcctgaacagt

SEQ ID NO: 18811 - DNA, 87 bp, Homo sapiens
ttgtattaaaaagtaggatttattgagtatgtatcttctaatggaaaatattaaggaatttaatgccttaagaaatctagttaaagg

SEQ ID NO: 18812 - DNA, 506 bp, Homo sapiens
atatacccggctagggacacgagagacaggaatcggggtttctgggtgacggtgatctcggggtgggcaggactccaaaggcccgtcgacccggtggtggactccttgcactgggattggacatatgcaagcgggagatttgsggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctgaatgactttctcacsggtgtgtttcctgccagccccctcagttggcttttcctcttca

SEQ ID NO: 18813 - DNA, 484 bp, Homo sapiens
ttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcac

SEQ ID NO: 18814 - DNA, 991 bp, Homo sapiens
acacacttagcttttttgtcacacttatcctttgtctccgtaaatttcatttgcagtggttagtcatcagatattttagccacctacdaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaatatctcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagraaattgaacaaatgtaatggatcaatttaaaatattttatttcttaaaagccttttttgcctgttgtaatgtgcaggacccttctcctttcatgggagagacaggtagttacctg

SEQ ID NO: 18815 - DNA, 509 bp, Homo sapiens
cttcatgaaaaagtatagctccatagtttaatggatatagacccagatgtcctgggttctgtgacctcgggtttttactttaccttttggaattactataaggattaaggaaattaatattataaaacacttaaaagaatacagggcacatatgcaacggtttgaatgaaaatatctcacttgggaaattacacacaaacttttttcagccaataacctaatgttattgaactcttggctgggcgcggtggctcatgtctgtaatcccagcactttgggaggccgaggtgggcggatcacaaggtcaggagatcaagaccatcctggctaacactgtgaaaccccgtctctactaaaaatacaaaaaattagccgggcatggtggcgggtgcctgtagtcccagctactcaggaggctgaggcaggagaatggcaagaacctggatggcggagmttgcartgagcccagatcgcaccactgcactccagcctgggtgacagagcaagaa

SEQ ID NO: 18816 - DNA, 561 bp, Homo sapiens
aactgcttctctctctctcttttactcttattctttctctctcactctctctcttttcccacccttaagccaagtacagggatagttgtctcatcattggtggcttaaaatgatgtttttgaacaagaagacrccccatgggtacttttggtgactagcactatctctgtttttttccttttaaattcctgagctatkgtttagcagtacacccttttatctccattgctactgaagctgaatgttacttgggtggaaagcataactgctttcttttctatgtccttaaaccctttgataatgttactgtttgagagtccctgaagccaggatattagaagagtctggcttgtctgaacagctgaactacgaaataatggagtagggcagcctctaggtgctgtgctgtcctgaggcctgggccatggtgcccaaggaaagcccctgaagctcaccaggaggaagaagcatgcagggcactcctggaggcgggacsgccctgggccatcccccgtggacaggcggacactcctggtcttcagctttatcctggcagcagct

SEQ ID NO: 18817 - DNA, 487 bp, Homo sapiens
agagcaggagagagtgaatggggacgtgctacacacttttaaataagatctcgcgagaactctatcatgagaacagcagagcaggagccactttcaaataacaagatctcttgaggactctatcacgagaacagcagagcaggagagagtgaagggggacgtgtcacacactttcaaataacaagatctcgcgagaactatcacgagaacagcagagcaggagagagtgaagggggacgtgctacacattttcaaacaacaatatcttgcgagaactctgtaaggagaacagcacggggaagtctgcccccatgattcagtcacccccccatcaggcccctccttcaacacacggggattacaattggatatgagatttgggtggggacacagagctgaaccatatcaacatcctattctacagttcagtatttccagtagctttgttttgcctactgggtcagatgaatacacatagaatataaaa

SEQ ID NO: 18818 - DNA, 504 bp, Homo sapiens
aaaaacttcctaactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctatkgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgaggctgggctttccagctctaggtgctgtgtgtcctgaggcctgggc

SEQ ID NO: 18819 - DNA, 533 bp, Homo sapiens
aactgcttctctctctctctttactcttaytctttctctctcactctctctcttttcccacccttaagccaagtacagggatagttgtctcatcattggtggcttaaaatgatgtttttgaacaagaagacrccccatgggtacttttggtgactagcactatctctgtttttttccttttaaattcctgagctattgkttagcagtacacccttttatctycattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgagcctctaggtgctgtgctgtcctgaggcctgggcatggtgccaaggaaagcccctgaagctcaccaggaggaagaagcatgcagggc

SEQ ID NO: 18820 - DNA, 440 bp, Homo sapiens
actcttactctttctctctcactctctctcttttcccacccttaagccaagtacagggatagttgtctcatcattggtggcttaaaatgatgtttttgaacaagaagacaccccatgggactgatctcaaatgcagctgtgactaaaacctctaggtgctgtgctgtcctgaggcctgggccatggtgcccaaggaaagcccctgaagctcaccaggaggaagaagcatgcagggcactcctggaggcgggacggccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggarggcctgaaamcccagaaggtggacttctggcgtg

SEQ ID NO: 18821 - DNA, 593 bp, Homo sapiens
tttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgtttgcagttatttgaagtagaactgattgtctaaaccagacacacataggagtgtgctccattggtcttgtggagagtgctgcacattaacccctccctcaactgtgcaatccacttgagactggcttctcta

SEQ ID NO: 18822 - DNA, 205 bp, Homo sapiens
attgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttttttttttttt

SEQ ID NO: 18823 - DNA, 206 bp, Homo sapiens
attgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaatttttttttttttttttttttttw

SEQ ID NO: 18824 - DNA, 195 bp, Homo sapiens
attgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttt

SEQ ID NO: 18825 - DNA, 490 bp, Homo sapiens
ggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccggcttctcccctgtgacgggaaggcaggtgtgactccaggctctgcactggttcttcttggttcctcccaccaggccctttgttcctcatgtccccatgtttctctccctctgcgtcttagcacctttcttctgttc

SEQ ID NO: 18826 - DNA, 402 bp, Homo sapiens
aataatttctttacagatgttttatttaagcaggtagcacaatctactaatgttgtttgatctgtgtttgttatactggttgtaattaattttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctctatgtactgtttttcctcatacaagtaaacacagaatgtcaaattcaaaaaaaaaaaaaa

SEQ ID NO: 18827 - DNA, 433 bp, Homo sapiens
acaatgatctgggaagggcaactagccataggcactgctatttggttcagagaagcaccaattaattcgactgctctctgatccacttgaagaactcagctggaaatcaaacaaagccaacctaaaaaaaaacgtctaacactagagtattcctgtatcctggagaaggcagcactcgagccaccatcttggaagtgaagatcaggccctcagcagacacaaaacctgccagtgccatgatcttggatttttcaacctgcaggactattcaatgaaattccaatgaaaatctcaagttattatgtgaatattgaaaaacgaaccctaaattttatatggagagccaaaaaatgcaaaagagccagcacatattgaaagagaagaacaaagtcagaagattgacactacctgacttcaagacttatgataaagc

SEQ ID NO: 18828 - DNA, 445 bp, Homo sapiens
ggaccggggcgggtccagtcccgggcgggccgtcgcgggagagaaataacatctgctttgctgccgagctcagaggagaccccagacccctcccgcagccagagggctggagcctgctcagaggtgctttgaagatgccggasgcccgcctctgctgttggcagctgtgttgctrggcctggtgctgctggtggtgctgctgctgcttctgaggcactggggctggggcctgtgccttatcggctggaacgakttcatcctgcagcccatccacaactgctcatgggtgacaccaagagcagcgcatcctgaaccaygtgctgcagcatgcggacgccggggaacgcacagagcgtgctggaggccattgacacctactgcgagcagaaggagtgggccatgaacgtgggcgacaagaaaggcaagatcgtggacgccgtgattc

SEQ ID NO: 18829 - DNA, 444 bp, Homo sapiens
ctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagagggga

SEQ ID NO: 18830 - DNA, 282 bp, Homo sapiens
acttacatcatcatctggcttcaggctgtgctacagaaaacaaacagcatttttgagtggttaaaaagtcagcctgaaatattaaaaaatggggcaaatgttgcctcctggttgaatagaacagttttcttgaaaaatggagtggagccaggggtcgggggaaggaagtgtttccgagggcaaacgttggtcttagatccggtctgcattgctccagtgtgtgcacgccgaggagctttctgtagacgctgagggttatgttctgcttcgtttttgattttc

SEQ ID NO: 18831 - DNA, 522 bp, Homo sapiens
aatctggacggtccgaccgcctcgtgcttggtgggtttacaaactctgactggttcttaccacccatctaacaggaaattttttttttttaaaaaacaaaccaacccataaaacatctgaccagatgccacactcaagaaaacacttgtattcgggtgttttaacctccaacgatggaaatctgcttaacattggtgtttctgaggtgtcttagcatcagaaaaggaaaaagacacatatacacacattctaaggaaaaagtcaggaagggccttgcagagtggtggagccacagtgttaaagaacagagaagtgatccttaatcatttagaattttgcctccaccatccaccagaaaatgaagtggaaagagaagttgggggatggtgtctatgacacttcatgatgatagatgaaaccaaatgtcccccctgttcaaatgtactctgcaatccttctgaaccacctccacccagaagactaaatgctggagtgcagtggtgtcatgtcagctcattgcaa

SEQ ID NO: 18832 - DNA, 522 bp, Homo sapiens
  misc_feature 242: n=a, g, c or t
atcaccccaagttccagtcctaggctcctcctactggagacaccggagtacaagcatcccttttagctctcactctaattgtgtatctgtttcggaaccttttctccgtgtcccttctggttttcccgctcccgctccactaaaaagtcccgttgtctccggaaaccctaaatccagtcttatatttcatcttccaaggaacccagaatcagacttccttttccctgaggacctcaggtcgnactcccgccccctctagtcccgtaattttgaacacgcagcctttcacccttaagggaccgggccctaagccatcttccctcaggcaccaaagctctcttccccgtcccgggacagccgccagccgtctccagtccactagcgcctgtagatgaggaatctgcacctacgtgggccttcaataaactcccggtggtcctgcccacgactcttaactgtggtgaggtcacaakgaaaccaggtcgtcataggaatcagtcaaaacccatccccagaccccaa

SEQ ID NO: 18833 - DNA, 445 bp, Homo sapiens
ccaagatggccgcccccgtggatctagagctgaagaaggtttattcttcagtccaaggaagcaattcacagtcagctgttagagaagcagaaaatagcagaagaaaaaattaaagaactagaacagaaaaagtcctacctggagcgahvtaaggaagctgaggacaacatccgggagakgctgatggcacgaagggccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgctgcsacctctgcccaggacactcttccctctcgggatgtgtgatgaactccca

SEQ ID NO: 18834 - DNA, 394 bp, Homo sapiens
aagtctcgcgagcgaaccggcaatccgagaagagtaatgtcttgctctccgccctgacaacttttatgtattataatttgaccgcgctgggccacgctgcgagtcgcatcggaaccgctgcgttaacccakccccggaaataacgtaccgatcttcggagtccaagtcggaagttgactagagagtcacctgctttcgtccgctctaggacaccagacacaccaggccgccatgttgtgtaaggatccccagccagtgrgcctaaaatgggaagaaggaaaagatatttcttaccctacgcacccaggtccaagtcatcattattttgtctgaaatttatcttcctaactgatttctctgcttccccattgtgccttaagagttagttttccac

SEQ ID NO: 18835 - DNA, 532 bp, Homo sapiens
tttctaacaagaatttctggaaggcaagtcatcactatgattgggaaagaagccaaaattataataaaatgaaaacctgtgcatcaaatctgaaggatgagtataaaataggataaacagtcttaaatgaagaaattcaaaaataggaagctgaattacttctctgaggatgtcttgtcactaaaacatggagaatccaacctaccctgcgtagttgtggaatccctcagatgacagcagtgaagattattaatgaagatgttaaataagaagaaagcaacatccttccccatgtactgcagttgaattactaatcacttcacgaatgctgaagaaagcattttaaaaaagttttttctgcaatatatacaacctacactgaaaaatcttaagctatatgtacttcattcaattcattcatgcatacgaatattcaaaaccttcatttaagctcaaaggccatggagataaaaaagaagacaaattaaccagttgacaaggacctagctgtccaatgtgttgactttgttgt

SEQ ID NO: 18836 - DNA, 464 bp, Homo sapiens
attctaacaagaatttctggaaggcaagtcatcactatgattgggaaagaagccaaaattataataaaatgaaaacctgtgcatcaaatctgaaggatgagtataaaataggataaacagtcttaaatgaagaaattcaaaaataggaagctgaattacttctctgaggatgtcttgtcactaaaacatggagaatccaacctaccctgcgtagttgtggaatccctcagatgacagcagtgaaggtgatccctaggcatgctaaaggcagagaagcactggtctaaactgcagacatggttttggggatatgaagaaagaagagatatcagagatatttagcagattattaatgaagatgttaaataagaagaaagcaacatccttccccatgtactgcagttgaattactaatcacttcacgaatgctgaagaaagcattttaaaaaagttttttctgcaat

SEQ ID NO: 18837 - DNA, 188 bp, Homo sapiens
  misc_feature 94,140,149: n=a, g, c or t
aagcctgtcacgtcacgtgagaggaactaghcttaghgagghcatgggggaaaaagtctaactggcggaactcctgggaactggggcgatgggntmttagtatcggaggattggagmcatctgatttttahctgaaattnmttagthtntcctgtgttggggaaatggtaagtaagacagattttcac

SEQ ID NO: 18838 - DNA, 265 bp, Homo sapiens
agcttccgccggaasgctcctgtcagttgttctcaggtgtttgggcttgttgttccgtatactcagtgggttcgcggccgccggccagtgaggctgggttcgaggagctggagcgcgaaactggagcttaaattctggcggcgagatggacattctgaaatcagagatccttcggaagcggcagctggtggaggacagraacctgctggtggaaaataaaaaatatttcaagcgtagtgagctcgccaaaaaaaaaaaaaaaaag

SEQ ID NO: 18839 - DNA, 374 bp, Homo sapiens
catttgcctctcaagcagcctctggtcatctatctgcctttgagccatcaagatgccgatgtcttctcttccagcagctattttgtctcacatgacagctattaacaatgtgcctcctcctccacttcacagtataccaaacttgaaaaagtctaagcacattaattatggccagttgaatgcattatgccacattagaggacaacacagagagagakaakaaggcatgcaactttgatattgcttggatttctgtcaagagggatcattttcccctgtgcattgctgcctcctccttgcacccagtgcctttcgacatggagtaaagaatgaagtccacacactcccgagacctattgcctgatgtgaatcct

SEQ ID NO: 18840 - DNA, 439 bp, Homo sapiens
ttctccagttttgtgggtcagggatactgcttgttggggcattatgttaacagtaacattttgaaacatactttcatgatagtccagcaaaaaacagcatcaaaactatttccattgtatctctttagaaggctctgtattcggtaaaaagtctagctggcgccattggaatatgggctgctaaagactcaatttctagttgatgtttgaggtgaggcaaaaataaagctaaggtagaaaacttaagctttgtgggatttatttatgcgcctggcatgttgacttaaggaactcaaccttatgtacaggcttggcatttaaagaaaactggtggctgggtgtggtggctcactcctgtaatctcagcactttgggaggctgagaggatcacttgagcccaggagttcaagactagcctgggcaacatggtgaactccat

SEQ ID NO: 18841 - DNA, 452 bp, Homo sapiens
ttctccagttttgtgggtcagggatactgcttgttggggcattatgttaacagtaacattttgaaacatactttcatgatagtccagcaaaaaacagcatcaaaactatttccattgtatctctttagaaggctctgtattcggtaaaaagtctagctggcgccattggaatatgggctgctaaagactcaatttctagttgatgtttgaggtgaggcaaaaataaagctaaggtagaaaacttaagctttgtgggatttatttatgcgcctggcatgttgacttaaggaactcaaccttatgtacaggcttggcatttaaagaaaactggtggctgggtgtggtggctcactcctgtaatctcagcactttgggaggctgagaggatcacttgagcccaggagttcaagactagcctgggcaacatggtgaaactccatctctaccaaaaa

SEQ ID NO: 18842 - DNA, 225 bp, Homo sapiens
aaaaaaaactttaaacagattgaaataaaacagaaaagtaaatgtttttaaaaacttccttaaataacttattgctatgatatcttgtttaacattgtgatattgtacagaaccagagtttgtctgtagtatcatctagctgtagagtaccctgcttggccaaatgaatcactttcatttgtccagtgcaactgaaaatttcccaaaaaaaaaaaaaaaaaagct

SEQ ID NO: 18843 - DNA, 438 bp, Homo sapiens
aatcagaagattggcaggatttaggaatctatttgaaatattcattacctattttgaattggtcttaaaaatttaaagaaatataaagctggataattaaagataaataataaaggaagaatacaaggtttctatgctgtgaacaactgagattattatgattttggggcagtgaatttgtttctagaagttttgttggaactaaggcagaaaggaagaagaacaaatgaccttggaatgaaaaactttaaggacttggagctcacactttaaaaaagaagatcattctaactgcccctcatgactactgaagaggctatgctgaaaaagcaaaatgtcctacgttagagatcaccaagcaagacttttttcaagaagcaaaaactctcattgcccaacattatgagaaaataaatgagaataaagttcaaggtactt

SEQ ID NO: 18844 - DNA, 412 bp, Homo sapiens
aaggcgtggccgggtgtcgtgaggcgggccttcgggctggctcgccgtcggctgccggggggttggccggggtgtcattggctctgggaagcggcasagaggcagggaccactcggggtctggtgtcggcacagcatggcggcgcgttggtgcggaaagcggcggactatgtcraagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgscacgcaacaaatgaagtagcccagctcatc

SEQ ID NO: 18845 - DNA, 494 bp, Homo sapiens
aattccatttaactatgttactacatatcttctcagagttaaagttttgctagagtctaatcaaaacataagcacagaattaaagtttctaaaatgtatttacattttacccctgtgctaaagaaggaatgagcaataatcgaaagttaatagagttggccgggcacagtggctcacacctgtaatcccagcactttgggaggccgaggtgggaggaggatcactgaggcccacaagtttgagaccaacctgggcaacaaagtgagatcctgtctctattttttttttttwaattttttataaaacaaaggtaacagggttatctttttgtatatttgggaagcggtgatagaggacatgtggatctactgagtcagtccttctaaaaaagaagcttgaagaacatctagagaagctgcatgaggccaataatgaactacagaagaagagagccattattgaagatctcgmgccaagatttaacaacagctcct

SEQ ID NO: 18846 - DNA, 401 bp, Homo sapiens
acaaaatagttgtgttatctacagactgtcactttttaacaatagcttgactttttttggtcttttaaggtctcatacaaatgtttgcaaaaaagagtatttacttactatttcttttcacttaactttctcctgcccctgtccttggctgtaagtgtgtttgtgtttcttcctaataaaatgaagtgggtgtgtctcttagctgttttcattgtgaaacttttattcttttggtccctgaagtattgcatttctttggcttcttctaaacttatgtagcctatggagctatttatctggtctgttgtgatggagatgagaggaacatttggatttcatttaacttcttagttgcctttggaggcaatggaatttttactggataaaaagacaaacttatg

SEQ ID NO: 18847 - DNA, 352 bp, Homo sapiens
aaagtcccagcaagaaaagaaggaaaaggaatgccaagcagtcatgttagcagtttgaaggggctggagcaagatggaatcaggaataaggagtcagtgggaccatgtacaacactggaagacacgtatcccttcgcctggacaaggagcacttggtcaacatatctggagggcccatgacatacagccaccggctggaaggagatccgactacactttgggagtgaggacagccaagggtcggagcacctcctcaatggacaggccttctctggggaggtgcagctcatccactataaccatgagctatatacgaatgtcacagaagctgcaaaagagtccaaaatggatt

SEQ ID NO: 18848 - DNA, 416 bp, Homo sapiens
agttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccwtgaaagaagaagatgragaagaaatagttacctatgatcgacaaaatcaaagggacccttaggaggagagtgtgtcattttctaggggaaaaaagaagttttcagtgcctcagctcttgccaggctgaagagacaaagttgtgtttatcttgaaaagtctttcagtgcgtggtgccacttgtcctggagaacacaccagcctctgcccctgcactgt

SEQ ID NO: 18849 - DNA, 489 bp, Homo sapiens
agcttagctaagtcatctggggcagtggggcacaatccacagatctaccatcattatggaaagatggtcctgctctgttgtgttttcaggaaaaacgaaagggctcccaggcctgcttgatgcttccagatgcctggtgacaggaatcaagaaccagggaaaggcctcaggatgctgagttcagaaattgtgacgatcgaggggtgagaaatcgagagcagatgaggaagctggttctcgtcaagattaactgacttgccccaaattacacaacctgtaaatgcataaggaggaaccacatcaattatctgcctctgaggcacacatttaaaacatttcctctgctgctttcatttcctaatgtcctggggccaacctgaggctcatctgagggaggtgtctgagcttcatgcaagagaccttgatgtgttctaatggctaatgcagagtctttgctcacatgtctacatactgagtaccatgctgaat

SEQ ID NO: 18850 - DNA, 80 bp, Homo sapiens
ctcttcctgtctgtaccagggcgrcgcgtggtctacgccgaktgacagagacgctcaggmtgtgttctcaggatgaccga

SEQ ID NO: 18851 - DNA, 357 bp, Homo sapiens
agaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccaaaaaaaaaaaaaaaaagg

SEQ ID NO: 18852 - DNA, 360 bp, Homo sapiens
acttcaattcagactaggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaa

SEQ ID NO: 18853 - DNA, 360 bp, Homo sapiens
gactaggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaataaagaaaattccttaacctttg

SEQ ID NO: 18854 - DNA, 377 bp, Homo sapiens
agactaggccacgaagctccttagtgaggagctgccatgctgggccatccaccatctggattcctacgactcagggaatagaacactgcaccttccagaagcacttgtttcttcgtgggtacaccaccasctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaaaaaaaaaaaaaaaaaaaaaaaaaaaar

SEQ ID NO: 18855 - DNA, 382 bp, Homo sapiens
agactaggccacgaagctccttagtgaggagctgccatgctgggccatccaccatctggattcctacgactcagggaatagaacactgcaccttccagaagcacttgtttcttcgtgggtacaccaccagckmagaaagaagcctcatgatgattgttgtcttatggatgcttctcattgcaggaaccatgtggaagggatataaatatcccccaggagggactccagtggattaagcaaggatgatcctggtgaagtaatgcagctgtgaagctcacctgaccagctgtacagttcctgttgttggtttcacataaagtaattgcacattataaaaaaaaaaaaaaaaaaaaaaaaaaaaaaaaaaaaaaaaaaaaaaaar

SEQ ID NO: 18856 - DNA, 383 bp, Homo sapiens
  misc_feature 296: n=a, g, c or t
acttcaattcagactaggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccnvctgtacagttcctgttgttggtttcacataaagtaattgcacattaaaaaaaaaaaaaaaaaaaaaaaaaaaaaaaaaaaaaaaar

SEQ ID NO: 18857 - DNA, 427 bp, Homo sapiens
  misc_feature 114: n=a, g, c or t
aagatttcagcttctccactagggagttgtggatcctttggagccaaagactcgaacagacatgcgagacctctaccaactgaaggtttcgtgagcgcactcctttgccaagwncttggtgaataatctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgagtaggcgggctttaggtgaagatctgctgcagaaccatgtggaagggatataaatatcccccaggagggactccagtggaagtaagcaaggatgatcctggtgaagtaatgcagctgtgaastcacct

SEQ ID NO: 18858 - DNA, 391 bp, Homo sapiens
acttcaattcagactaggccacgaagctccttagtgaggagctgccatgctgggccatccaccatctggattcctacgactcagggaatagaaaactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaaaaaaaaaaaaaaaaaaaaaaaaaaaaaaaar

SEQ ID NO: 18859 - DNA, 485 bp, Homo sapiens
actacatcctattgtcaccaccattgaaatacatttggaatcttaagatcaaggaggagattgtggttataaatgtctgatggcatctctacatctcaggtgaagcatggaggatttcacagatgaaccttttttccagtccctaaagcaacacttgttgtccaccatgtatcagcagaaagcagtctgaggaaactggccaataaggaagcttacactcaaacaacaacttcagactcaggtattgaggataatgagcaagcaaggctctctcagagatcaaaggcaggaaccatggagaagaaaatataaaggagtttccagtagagaatcacaggcatcctgatgagataagcaaggaaccgtccacatatttaatatatatatatatdykgtwtgatctaagtgtaaactgaatttatgttttaagaagtgaaaacaattacactgtgaatgttaaaaagaatgattaacataactattaa

SEQ ID NO: 18860 - DNA, 335 bp, Homo sapiens
agagggcgggccttccgggacgagggcgcgtgggtgaggaaggtcaggtctagtttccatcacagtcaggcatgatcgattcaggtggagggagttgaagattgttcttgatgaactgaatgcagctaatacattttcagttgccgttgatgcctctatgactccgtaaaataatcggaactctaactccttgccactcaagaaatgtcctccctttcagaatatgccttccgcatgtctcgtctcagtgcyyggctatttggtgawktytccaggcctactaattyyaagtctatgaaagtkgtkaaactgtttagtgaactgcccttggccat

SEQ ID NO: 18861 - DNA, 453 bp, Homo sapiens
gttgactggaaatactaactacatctgatcagttcttgccttagatctagccaaatgacaaagttttattctgaagtctttgaatgaataggatggaatcacatcatatctacttttgtgttagaaaatgttggactgtcaaaaacgactcatcaacaccttctttcatggcaacaaacctctgtgaaatgccactatctgtagagcacagtgacagagtctgcaaatgaagaaaagataaagacacagcatataccttttgggggcctcaagaggaagaaggaatacttctaagagacttttttttaaaagagatcaaactggcaaatacaggatcccatagcccttcgaaggagacatgtgcatgcaggctcctgtgtggggtccacagaggttttttctgcaagcaatgctgcttatcaagagctgcctggagctggtgactcagagaat

SEQ ID NO: 18862 - DNA, 501 bp, Homo sapiens
atccggttgtttgaagatgcacggcccccacaccccctttcctctgcttgctacgggtctggccatgtgaagtgcctgctcccgcttcaccttccattactttcctgaggccttcccagccatgcttcctgggcagcctgcagaactccagcacttgaagtttcaaaaacgaggatcaagccgttcctgggagcatcctatgagacatttggacacaggtttacttggagtctcggagatatgacggaatctggaaaagtcaaaggraaaaaagccaaggttaatggaattcaagaacataaattcaagcagggacgatatagtgaaaacactactatctccataagtcagtctttttaattgcctaaagttttaaccaagtcccggagctttggctaatgatgaaagaggtaacagaacaaactcaagtctcttgtcgagcagatggagctggtggattccaggacactccccaagggagccagggatgaccatctacgg

SEQ ID NO: 18863 - DNA, 353 bp, Homo sapiens
aaaaactgtcatggcgctggcgggcgtgtcctatgctaatgagcaatgagggcggctagggattgcttttgtcgccatctgctggtttccaccggtttcttcacttcatcctgtgtggaccatcttttggtcagcaggactgtgaccagaagacaagtcctgccagtctcctacctcatttccaagagacaaaaagataggatgtgcagcggaatagaaaaaagacttagaaaacatattttaaacatctaatgaacatgttgtcagacacccagaaggaggagtgagagaatgggcagtgacaaaattgaagatggagtggctggaaagaggaccttcacagcaccacccac

SEQ ID NO: 18864 - DNA, 220 bp, Homo sapiens
aaaaacgatggaatgccgagtgttcctaggttctcatttctcccttcgctctcctcagacattagaaatatctaatttaccgggtaggaaagcactcaagaggtttcvtcaacactacctaggaggagtgacagcagcaagtcaggccttcttcctcaagctctcactgcacgttctcaaggctgccaagaaaagaaaaaatagaagagaaaaaaacaaa

SEQ ID NO: 18865 - DNA, 228 bp, Homo sapiens
aaaaacgatggaatgccgagtgttcctaggttctcatttctcccttcgctctcctcagacattagaaatatctaatttaccgggtaggaaagcactcaagaggtttcctcaacactacctaggaggagtgacagcagcaagtcaggccttcttcctcaagctctcactgcacgttctcaaggctgccaagaaaagaaaaaatagaagagaaaaaaacaaaaaaaaaaa

SEQ ID NO: 18866 - DNA, 177 bp, Homo sapiens
aaggagcccagctgacttcccccagtggatcgttttagggctgcaggcggastgcccaccactcctatactgtggcgaggggcagggagcatctgtcggggagcccaagcctcaggcaggtccttcaggagggattccagaagaaggcattgttatcataggagatgacagctccat

SEQ ID NO: 18867 - DNA, 446 bp, Homo sapiens
aaaggcggcgtgtccggagtttgttccttctgatgttcagatgtgttcggagtttcttccttctggtgggttcgtggtctcgctggctcaggagtgaagctgcagaccttcgcggtaagcacattaatcattccagtgtaatcagactgcatcaagattgtactccttctacttataaaaaagacttagctgtagaacagcctcaggcaagtccttcaggaagtattccggaagaaggcattgttatcataggagatgacagctctatgaatgttattgcccttgaagaccttccagtgggacaagacgcagaggtgacagacaatgatactgatgatcctgaccctgtgtatgcctaggctaatgtgtgtgtttttgccttggtttataacaaaaaagcttaaaaaataaaaaggttacttttaaaaaatgaaaaaaaaaaaaaa

SEQ ID NO: 18868 - DNA, 220 bp, Homo sapiens
aaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacgaaaaaaaaaaaaaaaa

SEQ ID NO: 18869 - DNA, 716 bp, Homo sapiens
aaaaaggtccacatggccctggttttgaccagttttccaacagtttcaacgttatgtatttcaacttcccgtctcagttcactggcgtctgcacccgttgccgagtgtgggtggctgagccctgggtgacagcactcgggaccacgcacccatacccttctttatgctcgttgtcagccagttgcsaagagcgggagtgaagagcctgcaasccgggagagcgcggattccggagtagggaggcgagggggcagcgtgggagaccagagggaaaatgggctgaaaagcaacaaaaaaaacaacgtaaattgggctttsctctggctttacaaaggcagagattgtcgagccctctgactgtctttgtsccttctttatcccgtcctttgtgaaataagccgttttctgcccccactgcaggagcctaggctgtgggcgactcgctagcactgccctgggcctccaagctgcctgctcgctgagctcagcgctgacactcacaggagctgcgttcgccgcatcctctgagaggctctgcaacgatcccgatccaattcagcagcgttttaaaaggaaactcgtgcagggccactgaaaagtcaggggaggctcagatgttatttcccacggattcctgtttttccagaaacgttgtcaccaaataagtatgagactgttaatttggagaaacaattagcccctgcaaaaaaaaaaaa

SEQ ID NO: 18870 - DNA, 250 bp, Homo sapiens
gttccctttcgtactcaaagctcgtgcatccagggaggggaaaccggagatagggtcttcgggccccgggcagaccctctgtgccgctgcaaaccgttgcagcctgaggctgtcaggtcctcccccagacacctgyggaccctccctctcctggcttcccgtctggtcatggcgagattctgggtctgcgtmscggtgctggcttctttcttgcattttttgaatgcaaaaccaaaaaaaaaaaaaaaaa

SEQ ID NO: 18871 - DNA, 238 bp, Homo sapiens
gttccctttcgtactcyaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtmscggtgctggcttctttcttgcaaaaccaaaaaaaaaaaaaaaaa

SEQ ID NO: 18872 - DNA, 269 bp, Homo sapiens
gttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtascggtgctggcttctttcttgcatttttggttttgcattckcgtttttgtggctcaaaactggagagccacaaaaac

SEQ ID NO: 18873 - DNA, 300 bp, Homo sapiens
gttccctttcgtactcaaagctcgtgcatccagggaggggaaaccggagatagggtcttcgggccccgggcagaccctctgtgccgctgcaaaccgttgcagcctgaggctgtcaggtcctcccccagacacytgcggaccctccctctcctggcttcccgtctggtcatggcgagattctggrtgcttaggccaacccacatccagccggtaaagaattttctcagttctccaggaaactgcaaaagtaaagttcctcaaaactggagagccacaaaaacgcgaatgcaaaaccaaaaa

SEQ ID NO: 18874 - DNA, 490 bp, Homo sapiens
aagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtascggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagagga

SEQ ID NO: 18875 - DNA, 482 bp, Homo sapiens
tttacaaagacaatgttcttcagcttgcaagacagtgaactgactaatattaagcatagctaaagaaataatgtgaaaatcaggagcatggtggtcagcttggggattagagtcataagaaatagaaaatataaggaacagttggcaggaccctccaaaccattgtccagaggagatgaaataatcccccttctattggtgggaccaatcccatcatgtccaccaacctgaggaggaagggctggttatacaatccatgagtgttcctgttcctgggagaggacagaaggggtttcaccgtgttaggcaggatggtctcgatctcctgacctcatgatctgcccgccttggcctcccaaagtgctgggattacacgcaagagccaccgcgcccggcgaggactgaatttttaacagcaggtgactcaggaagagctccaaatcacagcaagtacctgttgaccatgactacttatattgctg

SEQ ID NO: 18876 - DNA, 425 bp, Homo sapiens
acgtggtggctgggccggggaaatggcggcttcaggagagagcgggacttcaggcggcggaggcagcaccgaggaagcatttatgaccttctacagtgaggtgaacacagagtgaggagtagtggcaccggggcgaccgctcccggatctgctttcccagtggacaaaggcagtggccgcctggcctggaccgttgggcgattccttcagtccagtcttcggggtggcgggggtctgggggtgtgtgagcgtctcccactgatagctgctgggagatcccccggggcaacgaaagagggaatggtgttcgatctatcgagggaggtggcgagtgtgtccaacatagtgcgggcgcgcgggcagagtgcccaagtccgcggagtcgggggctggcagaggctgggccttcctgggagtgacttagc

SEQ ID NO: 18877 - DNA, 501 bp, Homo sapiens
aacttggctatagttttctaacagccttgtctacacatgtaaccagtttactcttaagtccctggattagttagtcaaaaggtgctctagagaaacagaaccaaagaatgtgtatacagaggcatatttattacaaagaattggctcatgtaattgtgaaagcttggttaaggccaaaattaagcagggcagagacttaggaaagagttgcagttgtgttcaaaagcagtcagctggctgaatttatcctcacttggaaaagcaagtaaagttgaggatgtattgtcagatccttgtacagaagaaaagaagtgaaaataatgaaaacaatggcaagagaagttactatttcccagaggaaaaacgctgctgtaaaaggagctcatatattttagctgtggtgttaattttgaagtcagcatgagtcattaaattaaagtattgtaatttggaaatatatttaaaatgaaaagamataaaaaagagtactagaaaatggaa

SEQ ID NO: 18878 - DNA, 476 bp, Homo sapiens
aacttggctatagttttctaacagccttgtctacacatgtaaccagtttactcttaagtccctggattagttagtcaaaaggtgctctagagaaacagaaccaaagaatgtgtatacagaggcatatttattacaaagaattggctcatgtaattgtgaaagcttggttaaggccaaaattaagcagggcagagacttaggaaagagttgcagttgtgttcaaaagcagtcagctggctgaatttatcctcacttggaaaagcaagtaaagttgaggatgtattgtcagatccttgtacagaagaaaagaagtgaaaataatgaaaacaatggcaagagaagttactatttcccagaggaaaaacgctgctgtaaaaggagctcatatattttagctgtggtgttaattttgaagtcagcatgagtcattaaattaaagtattgtaatttggaaatatatttaaaaaaaatgcgaa

SEQ ID NO: 18879 - DNA, 319 bp, Homo sapiens
agaatgttgatctctctgttggaacacaacttggctatagttttctaacagccttgtctacacatgtaaccagtttactcttaagtccctggattagttagtcaaaaggtgctctagagaaacagaaccaaagaatgtgtatacagaggcatatttattacaaagaattggctcatgtaattgtgaaagcttggttaaggccaaaattaagcagggcagagacttaggaaagagttgcagttgtgttcaaaagcagtcagctggctgaatttatcctcacttggaaaaggattctgtccctatagtcctctcaagcagc

SEQ ID NO: 18880 - DNA, 563 bp, Homo sapiens
atacacgagatcaccgaaaactcctcctttctcccattgttcctatgaggtgggtggggactccaaaacccgtagctcctgccctactaggccactctaccccattttccccacactcaccggagccaaagccgcgacccttccgtttcttcgctttttctttcagtttgtgaatgctctctggaaccccagaagataaaagaataagtaactatgacagtcatttgtaacaatcgtctctttcccaatacactaccagcaagccgacccacaccgcctccagtcttagtgccttcccggtcacgccctcccttctcctgaagggggcggaatctctaatccacccaagacccggttcctcgattcccaaccttacgaccgaggaaaaaagagtaaattttcctattatagccttctctcgcaccttccccgcttcccaccagccgtctccactgtcctcaccgtccccatcctcatccatggcgaaatcttcgccccagcctcgtgaagatctagcacgtccgcatctcgcttcgatcgagatctcgtctgtgccgctcaga

SEQ ID NO: 18881 - DNA, 460 bp, Homo sapiens
  misc_feature 195: n=a, g, c or t
ataatcctcacgcatccggctcgggacccctcttctataagggacatacacgagatcaccgaaaactcctcctttctcccattgttcctatgagtttgtgaatgctctctggaaccccagaagataaaagaataagtaactatgacagtcatttgtaacaatcgtctctttcccaatacactaccagcaagccgncccacaccgcctccagtcttagtgccttcccggtcacgccctcccttctcctgaagggggcggaatctctattccacccaagacccggttchtcgattcccaaccttacgaccgaggaaaaaagagtaaattttcctattatagccttctctcgcaccttccccgsttcccaccagccgtctcsactgtcstcaccgtccccatcctcatccatggcgaaatcttsgcccccagcctcgtgaagatctagcacgtccgccatctc

SEQ ID NO: 18882 - DNA, 461 bp, Homo sapiens
acaaatattttgtaccagtggctcatgctcactgcagagaagctggactggataatgactgcaagattttcttattccttgacaactgttctgctaatctttcaggtgaaattttcatcaaaaataatatctatgccatgtactttccccatattgacttaatcaatttagccatgtgaccagggtatccttagatcaaagaagagtaaatataaaaacgctttcttgagtagcacgctagcagcagtgaatagaggcacaggtgtggaagatttttaaaaggagtttagcatgaaggctgctgatatgctgtcaccaacacctggaacacagtgactaaagacacagttgtgcatgcctgacacaacctctgtcctgtaactatgttcagtgatgatgataaacaaggtggtgactttgaatgactcatatgtcaagtagaaaaaaaatgacgtcttacc

SEQ ID NO: 18883 - DNA, 485 bp, Homo sapiens
aagaataaaaccataagagataaaaacggcaacaatgggcacccaatgccaacggtcacaacaataaagatgaccaggacatttatgtaagagccgttgcaggagagctcaagaaggggaaggatgtcacacatgtagtgattgacaaggttgtctgcacaaaaggtgagaaacactatatttcctgtatgagccacagccccaaaaacccccatcccgtagacacccagtaaaaggagcaaacacacctggggagacatggtgaccgtgtacaacaatgggttacagatggccacgtagcggtcctacgccatcgccgacagatgaaggactcagaaaagacaaagaaacagaagaagaagaactgactcatacaccctgtgaaggaaataatgttcttccttgagacaaaactcatcagcattttgggaatgatggtcgtagagaaactaaaaatctacgagggacaagttgaaggggaaaaa

SEQ ID NO: 18884 - DNA, 496 bp, Homo sapiens
agaaggctgtgtatgctctgaatctgtgtccaatacatggtgcagtttctcccatagccaggattcacgggtccaggaatcaagaggtggaagtggaagtggcaccattcatcattatccctagtgaccccctagcaacatttttacttcctgttcccgcgacattatgttctgctggcctagaggtctcagttccagagggaggaatgtgccaccaggagacacagcaacaatgccattgagttaagattgccacctggacactttgggctcctcctacctttaaggcaacagactaagaagggagttacagtgttggctaaggtgactgactcagactatcaagatgaaatcagtcgactactccacgatgcaggtaaaaaagagtgtgcatgaatacaggagatccattagggcgtttcttagtattaccacgctctgtgattaaggtcaatgggaaactacaatagcccaatccaggcaggactacaaatgg

SEQ ID NO: 18885 - DNA, 936 bp, Homo sapiens
gaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactatgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaaatattttgtaatgcaaaaagtctcagt

SEQ ID NO: 18886 - DNA, 477 bp, Homo sapiens
ctcttccgccgccattttaaatccagctccatacaacgctccgccgccgctgctgccgcgacccggactgcgcgccasacccccctgccgacagctccgtcactatggaggatatgaacgagtacagcaatatagaggaattcgcagagggatccaagatcaacgcgagcaagaatcagcaggatgacggtaaaatgtttattggagcgtgaagggcctggtggcggtaataaccggagagcctcgggcctgggcctggccacggcggasgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcgggtggct

SEQ ID NO: 18887 - DNA, 138 bp, Homo sapiens
  misc_feature 48,120: n=a, g, c or t
aggcagcagcaacgcgaggaaacgggagtgaacggagagcgtagtrrnccatcatgagcctcctcaacaagcccaagagtgagatgaccccagaggagctgcagaagcgaagaggaggangaattttttaacaccggt

SEQ ID NO: 18888 - DNA, 136 bp, Homo sapiens
aaacaaaagattctagcctgaagaagagcagaatcaggtaaatctaaacaagtgagatttcattacgaaggagcctagaataggtattgttccttagactttttgatgtagttttctctgccggtgtttgtgtcct

SEQ ID NO: 18889 - DNA, 449 bp, Homo sapiens
tgaaataagaatgagtcagactacatatttggtagccagatttttttcactcagtgatatatcatgaacatatttccatgctaatataattttctaataattttagatgctgtaactacaatttcattgttaatgggcaatttgttgctttacaagtggtaaattatatgataaataatatgatcattattcttgtagccaatatcattattagaaatgatggaccgcattaaagctataaaattaaataagaatttataaatgtaaggagttattcagacatcttgtatctagtattacaatatcagaaaactcagcaggttatatgacatatacactttgagatagtcactcagaggttttcacatacaggattaaccttgctgcagtgcgtgtgcaagattaaaaaagatgtcatgggtcactttgtaatgtcatatcgttgctgt

SEQ ID NO: 18890 - DNA, 467 bp, Homo sapiens
taacctctccgtgcctttgtttctctacccatatggactggaaataggatatcaatcagcccgaaatgggggctgtcacatattaagctatcgacacatatattagacaaattgtaaagaatgtcttatggtatagaatcaagtttaataaactttttttttcccgtaaaggtcaggcagtaaatattgtgggctgtggttgtgggctacctatagtctctgttgcagttcctcggcaatatcattgtagcacaaaagcagccacagccactacatgggcaggtgggtatagctgtgttccaataaaacttaagtaacaaaaacgggttgtgggatggatttgacctgtgggctatagtttaccatgtgtttagaatatggactgtgttccggctgttacaggttcatgtgtgttacagggttgggtgtaggggactcattcatagtttttacattaatagccccta

SEQ ID NO: 18891 - DNA, 502 bp, Homo sapiens
atgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatg

SEQ ID NO: 18892 - DNA, 524 bp, Homo sapiens
aatattttcgaatgcttgagaaaactctgtacttatggaaatgtcccatgttgcactatccaatatgatagtcactaggcacatgggctgttgaacaatagaaatatggctaatgtaattgagaaactgaaaatgtaatttacatgtacatttaagatgaaatagccagacatggctactattataatggacaacacatttttacaaattatgagttgactttattataccagcctctatctcatacttccttattatcttcaaaacacaatcgatcaggaacaaaaacgtaatctcaagcttctagaaatttggcacactcaccaaagaactgaatactcctttgcagtcagaccatgtgttccagacaacataactagaaagatgtgagaaggcacttcatgtgggagataagccttgttttacttaatccactgagatgtcagagttaattgttacagcagcagcctgttgtataggctgactaacacatggtaactaacagaacactttggattcttgac

SEQ ID NO: 18893 - DNA, 250 bp, Homo sapiens
aaacaaaagattctagcctgaagaagagcagaatcaggtaaatctaaacaagtgagatttcattacgaaggagcctagaataggtattgttccttaractttttgatgtagttttctctgccgtgtttgtgtccttgcttatattttcaaatgaactccaggttacagggaaggctgaaaaaaaaaaaaaaaaaaaaaaaaaaaaaaaaaaaaaaaaaaaaaaaaaaaaaaaaaaaaaaaaaaaaaaaah

SEQ ID NO: 18894 - DNA, 409 bp, Homo sapiens
  misc_feature 57: n=a, g, c or t
agaaggagaagcgcgcttttttccctggcgggggatttggctagaaggctgggccgncagcggttgtgaggagttagctcgcggcattgcaggctctgagaggaggggacccggttcccggtggagtgtccaggcatgccagcggaacggcccgcgggcagcgcggctcggaggctccarcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattaga

SEQ ID NO: 18895 - DNA, 426 bp, Homo sapiens
cttctgtccacacacagctctgcaaggagagtgtcttcattctttccgccatcttgattctttgtcactgaccgagactcagccgtattctattttcagtgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaakggcctgacatggaagcttttcaacaggaactggctctgcttaagatagaggatgagcctggagatggtcctgatgtcagggaggggattatgcccacttttgatctcactaaaagtgctggaagca

SEQ ID NO: 18896 - DNA, 284 bp, Homo sapiens
  misc_feature 75..76: n=a, g, c or t
gcagaagggaaacgtgaagaaggtgaagatggcggtggcagggccggggtcttgggagtccagtggctgcaaagnncatcccggaacgtgatgccgctgggcgcacggacagcctcccacatgaccaaggacatgttcccggggccctatcctargaccccagaagaacgggccgccgccgccaagaagtataatatgcgtgtggaaracttacgaaccttacccggatgatggcatggggtatkgcgactwacccgaagctcccttgaccgctcaacaagcaa

SEQ ID NO: 18897 - DNA, 344 bp, Homo sapiens
cttctcgcctaacgctgccaacatggtgttcaggcgcttcgtggaggttggccgggtggctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatggagcaaaaagtaaaatctttaacccaagtctatgagtccaaacttgaagatggtaacaaaggacag

SEQ ID NO: 18898 - DNA, 412 bp, Homo sapiens
acgcgtgcggcctccgccgctggagctggatggctgatgcggctcgtggtccgagagccttgtcctgccgtgtgggccttgcggacctgggagctggcgggcgttgggaaccgggcttaagctactgaggcgtttgctgatttcgtccatccaggtgttcaggcgcttcgtggaggttggccgggtggctatgtctcctttggacctcatgccggaaaattggtcgcgattgtagatgttattgatcagaacagggctttggtcgatggaccttgcactcaagtgaggagacaggccatgctttcaagtgcatgcagctcactgatttcatcctcaagtttccgcacagtgcccaccagaagtatgtccgacaagcctggcagaaggcagacatcaatacaaaatgggcagc

SEQ ID NO: 18899 - DNA, 378 bp, Homo sapiens
acatgcgcagggttgggcgggtcttcttccttctcgcctaacgctgccaacatggtgttcaggcgcttcgtggaggttggccgggtggctatgtctcctttggacctcatgccggaaaattggtcgcgattgtagatgttattgatcagaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatagacctctacatcctgtgcttttctcctakyttctctccaccctggat

SEQ ID NO: 18900 - DNA, 351 bp, Homo sapiens
  misc_feature 333,345: n=a, g, c or t
agcaacggggtttcctgaaccttcgggccacccgaatccaccttctcagacggaaatagaatccagggattcttctacccatggaaaaacgtgcggaggaagcacatgtgggcgctggtctggacgtgcagcggcctcctcctcctgagctgcagcatctgcttgttctggtgggccaagcgccgggacgtgctgcatatgcccggtttcctggcgggtccgtgtgacatgtccaagtccgtctcgctgctctccaagcaccgagggaccaagaagacgccgtccacgggcagcgtgccagtcgccctgtccaaagagtccagggatgtgganggaggcaccganggggaa

SEQ ID NO: 18901 - DNA, 507 bp, Homo sapiens
tgttgttctctggagggggtgctgctgcctctccttgagtagttctgtgacccccaatccagctgtttkgtagagaatccttctagcttctggtatgcctgctctccagcagctggaaacagatcttcctgcctgaccaaagctccttgtttcttgcgtggcatgtttgttcttacccgatccggtggctgtcatagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggttttttaaactgtattt

SEQ ID NO: 18902 - DNA, 271 bp, Homo sapiens
ataaaatgtgctgtaaacctcattatatcataaggattttacctaaagaaatgcatgagtgacccctaaaacactgcagaagttttgactggctatccactttccttctcctgtttcctcactaattttacagaagatagattttctttagaaattcaaacttttgaaattgacgatttaccttatcaaacttaaaaacgtgtgttttgcatctgaaacattttctaggacaccaatacatactgatcaagtgtgagccttacttgatgta

SEQ ID NO: 18903 - DNA, 479 bp, Homo sapiens
aaaaacgttcagaatctcacccttcaggaaaagcgatgggactccgcggtgctccttgcctacgattcccgcactgcccatggggaacgaatcctatatcgctgagcgcttggtagggaatgtggactgtgaccctgagagtcgtccttccctctgcctgagtccttgagcgaaaatattgaatagacagcaattcctgaagtctaaacgcctcccaggactacggaggattattggaaagagaacaagcgaggagatacaatcttcaaggactaaatggggaatgactttttaggggtcagtagatgattgatgattgattactataaactgataatatgaggccaaaactaaaagttggaagagtgagcaagtacaatggtttgggagaggcaatgaagaacaaagaaggtgccagcccctactccagacgctgtggtaccactggtttggcaggaaaaacaatcatcatttgagag

SEQ ID NO: 18904 - DNA, 304 bp, Homo sapiens
agagtctagagcagcctttacagatggttttacagacggttttgcagaaaaacgtttcgctttcccttttttaaaaagatgtaaacatcttcccaggctcctctgacatcagcgtgtcagtgatgaatcatcgggaatctaaacacacgcactagagcacacaaaaccaacgttttcaggctggttcttgcttgcaagtgagagacttcatatgtgatggaacagaggagaggagcccctgggagctgttatatttaaatcaatattaaaaacaaaaattcgaccaccaaaaaaaaaaaaaaaa

SEQ ID NO: 18905 - DNA, 51 bp, Homo sapiens
  misc_feature 41: n=a, g, c or t
agattccggaaaggggaagagcagccagcatgsgcgaacgngcgcgggggc

SEQ ID NO: 18906 - DNA, 155 bp, Homo sapiens
ctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcatatgaagc

SEQ ID NO: 18907 - DNA, 155 bp, Homo sapiens
ctttccggcggtgctcgcaagckaggcagccatgtcttatcccgctgatgattatgagtctgaggcggcttatgacccctacgcttatcccagcgactatgatatgcacacaggagatccaaagsaggaccttgcttatgaacgtcatatgaagc

SEQ ID NO: 18908 - DNA, 424 bp, Homo sapiens
atcatagtttggagtgtaggtacagtagccccaggaaccatgctaggggttcagggaagaaacatagactgactagctaaccttgcctgctgatgtcacataaagtgataagaagtattgtggacccctgctaagtgcttttgaccacaactgactctagaaaaaggaggcacatttggatgagcaatgtacccctacagtcctccaggaagtcgtaatttgatrggagacaaagaaacatagccaaggatacaattttaaggtcaccttgaatccttcctggaaaaaagcaggtcataaataataatggttgttggagaaaggtctctaggaaagatgaagaacttttaaattcctagaagcatcttagaaaagataacacaaaaactttatttaatgtaaaaataagagctgagagtcagtt

SEQ ID NO: 18909 - DNA, 51 bp, Homo sapiens
  misc_feature 35,38: n=a, g, c or t
agattccggaaaggggaagagcagccagcatgsgncgnaacggcgcggggc

SEQ ID NO: 18910 - DNA, 361 bp, Homo sapiens
atttttcctggaggaagtttgggaaatgccgatttagcagattcttttgttgtgccgtggatggtgctggttgatgtgggcaaaacaaagaacacctcgcatggtcagtaaaagcaaagacgggactggaagcgatgacaaaaaagccaagggggctgatggtaaaacgaagatcgccacaccgcggggagcagcccctccaggccagaagggcaggccaacgccaccaggattccagcaaaaaccccgcccgctccaaagacaccacccagctctggtgaacctccaaaatcaggggatcgcagcggctacagcagccccggctccccaggcactcccggcagccgctccccgcatcccg

SEQ ID NO: 18911 - DNA, 381 bp, Homo sapiens
  misc_feature 362: n=a, g, c or t
actctttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagagatgtatatttaattttttaactgctgcaaacattgtacatccaaattnaaggaaaaaaatggaaaca

SEQ ID NO: 18912 - DNA, 52 bp, Homo sapiens
  misc_feature 43: n=a, g, c or t
agattccggaaaggggaagagcagccagcatgggtcgtaacgngcgcggggc

SEQ ID NO: 18913 - DNA, 391 bp, Homo sapiens
amtycttttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtaca

SEQ ID NO: 18914 - DNA, 51 bp, Homo sapiens
agattccggaaaggggaagagcagccagcatggcggcggaacgggcgcggg

SEQ ID NO: 18915 - DNA, 333 bp, Homo sapiens
ctctttctcgactccatcttcgcggtastgggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctggaggatgaggccactctgggccagtgcggggtggaggccctgactaccctggaagtagcaggccgcatgcttggaggtaaagtccatggttcmctggaccgtgctggaaaagtgagasgtcagactcctaaaggtggc

SEQ ID NO: 18916 - DNA, 447 bp, Homo sapiens
attctcattgctgggtctccactcctagctgttactgcaagtccatgcctctaccatgagggtggaggagttaagatcaacagatccacatgtaccttgaggtgacagactggctctgaacaagttgaaatcatcgcagaaggataaagttcgtcagtttatgatcttcacacaatctagtgaaaaaacagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaagaatccaggacaaaaaggattagatctagaaatggccattgcctactggaac

SEQ ID NO: 18917 - DNA, 506 bp, Homo sapiens
actcatatacccaaaaggatgggattaaaaactaattacataaaatacttaaaaatgcaacacaagtgcctgttttatttctctgttctcataccataaatgagaatttgtaaaacacattatttcttttaaattgcaaagactattcctgcagtaatttatgagatttatttgctaagaagtctttactaatctgtgggcagaggtgtggcaagtcacttatcaagatatattataacagtgagaaaatccaaagaaaggattgtgctgcagctccttatccagtttctctttcatcctggacatctggagtgttttctgctaatagtaaatgaactttgtttcattacctgtatgaggtttgacgtcatcgaaatagcctgtgtctttttttcagcctgatctgtgccactctgacagtgttgcaaagatggtctgctgtgccacgcctgagcagttagctgttcacagcctggcgcacacacctttaccacatacttttccca

SEQ ID NO: 18918 - DNA, 215 bp, Homo sapiens
acgatatttgctgcgacccgcagcgctatccgctgccgggttctggcgcgccctttcagttctgcttgctgtccgcacsgctgcgttacccggaaccgccgggccgaacagcatgacgtccgctttggagaactacatcaascgaactgttgccgttattacatsaggatgggagaatgattgtgggaacactgaaaggttttgaccaagaccat

SEQ ID NO: 18919 - DNA, 485 bp, Homo sapiens
aagagaaaataccccttcccttggtcacagactgcttgggtcagcatgtgaaccaatgcatacttaggcatgaatagggagagagtgaaaggtaggatgtggagtaaaagagtatttacaggccaggaaaaactactccttcccgaatggaataataaactgcaatatgggtctcaataatgccattagttagctgtgtgaacttggaaacacctcttaacctctttgaaattcagtttttcaattgtactaaaacggaattttgagctagaaggtctcaggtctaagttttatgatattatttcgatagaagaaagtttatggtttgtataaaagtgtatcttgaagatctgggtatgagccagtagctcctgtagaaatcttggaagtctgggctgggcgcgatggctcgcgcykgtwaatctcagcaccttgggaggcctagacaggtggatcgcctgaggttgggagttcgggacagcctg

SEQ ID NO: 18920 - DNA, 52 bp, Homo sapiens
  misc_feature 35: n=a, g, c or t
agattccggaaaggggaagagcagccagcatgsgncggaacgggcgcggggc

SEQ ID NO: 18921 - DNA, 411 bp, Homo sapiens
atcaggtctaaaattgaaacgtggttttaaacatataatttcttgtttattttcctccgtaactacctaaggatcaccacgatgaaygacacsgtaactatcygsacyagraagttcatgaccaaycgacyrctycagaggaaacaaatggtcaccaatgtccttcaccatggaaatgcaacaaaatgtacaagatcataataggtgtcatcttcatattaatagttggactcagaacccatgttggtggtggttaaacaatgggctttggcatgctatctggttctttgaattatgcaaagaaaartgaactcaaacatagacttgcaagacacagctgacatgagaagaaaacgacctcgagaaaacagcaaaaggaatgcaagggcagaatgaagtcaagagactgta

SEQ ID NO: 18922 - DNA, 52 bp, Homo sapiens
  misc_feature 37: n=a, g, c or t
agattccggaaaggggaagagcagccagcatgsgcgnaacgggcgcgggggc

SEQ ID NO: 18923 - DNA, 52 bp, Homo sapiens
  misc_feature 35: n=a, g, c or t
agattccggaaaggggaagagcagccagcatgsgncggaacsggcgcggggc

SEQ ID NO: 18924 - DNA, 421 bp, Homo sapiens
agatagatcgccatcatgaacgacaccgtaactatccgcactagaaagttcatgaccaaccgactacttcagaggaaacaaatggtcattgatgtccttcayyccgggaaggsgacagtgcctaagacagaaattcgggaaaaactagccaaaatgtayaagaccaccmcgggwtgtcatctttgwatttggattcagaactcattttggtggtggcaagacaactggctttggcatgatttatgattccctggattatgcaaagaaaaatgawcccaaacatagacttgcaagacatggcctgtatgagaagaaaaagacctcaagaaagcaacgaaaggracgcaagaacagattgaagaaagtcagggggactgcaaaggccaatgttggtgctggcaaaaagaagtgagctggagat

SEQ ID NO: 18925 - DNA, 51 bp, Homo sapiens
agattccggaaaggggaagagcagccagcatgsgcggaacgggcgcggggc

SEQ ID NO: 18926 - DNA, 52 bp, Homo sapiens
  misc_feature 35: n=a, g, c or t
agattccggaaaggggaagagcagccagcatgsgncgaacgggcgcgggggc

SEQ ID NO: 18927 - DNA, 307 bp, Homo sapiens
ctggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaagagtaaaggtgctgcaatgatgttagctgtggccactgtggatttttcgcaagaacattaataaactaaaaacttcatgcgaaaaaaaaaaaaaaaaa

SEQ ID NO: 18928 - DNA, 51 bp, Homo sapiens
agattccggaaaggggaagagcagccagcatggcggcggaacsggcgcggg

SEQ ID NO: 18929 - DNA, 53 bp, Homo sapiens
  misc_feature 36: n=a, g, c or t
agattccggaaaggggaagagcagccagcatggsgncggaacsggcgcggggc

SEQ ID NO: 18930 - DNA, 485 bp, Homo sapiens
atagtgtttgtaataaagcagcagagagacatagatggacatgagatttgtagtgtcagacttttcaacggaaaatttaaaaatcaaaataataaagttgtagtatctgaaaatagataaacagcaaggawaggagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtcccctccttcaaggttttttcagcagctgcagcacccgttgycccacctattgcagctgagcctg

SEQ ID NO: 18931 - DNA, 355 bp, Homo sapiens
  misc_feature 351: n=a, g, c or t
attaagtgttagctagtttgggaggtcggcaggggtggggaggatgcaaaaaagccctcatcacagcgctcctgacagctcccgccagccagctccccaaatcccttaggaaaatggcctcgacctctcagctgcaactctggcccagccgccatctcctgacctgaccgcccacttctggggagccccggtgggtctggattggagagagccaccctcagccctccccaccttcattggaccacagctgtctccttcaccatcacctccgtgcccaccaggattacaggcctgatctgaacccctaatctagggaagaaaaaaaaaaaaaaaaaaaaaaaagaaraaranaaaa

SEQ ID NO: 18932 - DNA, 330 bp, Homo sapiens
attaagtgttagctagtttgggaggtcggcaggggtggggaggatgcaaaaaagccctcatcacagcgctcctgacagctcccgccaggccagctccccaaatcccttaggaaaatggcctcgacctctcagctgcaactctggcccagccgccatctcctgacctgaccgcccacttctggggagcccsggttggktctgrattggagagagccaccctcagccctccccaccttcattggaccacagctgtctccttcaccatcacctccgtgcccaccaggattacaggcctgatctgaacccctaatctagggaagaaaaaaaaar

SEQ ID NO: 18933 - DNA, 440 bp, Homo sapiens
gatcttccgggtacacgccaccggaaaaaggaaaaaagcctcggaggggcatgccaataacgcctttaacacatggcgcatgcttgcttcccaaagctaaggagggctctgtgcaggcggcascmaccctaagggaagaatcatgggaaagagatggggaactgcgacatgaagaagttaacttacctaagatcagagaatgagtcaaggacagaacaggaccatgtcatcaaatttagagaaacttgaactatcatatctcattttggactagccatctttcaagagctcaacagccacgtgctattaatggctaccacattaaaggctccaagtctagatggaaaataaacaagtaaacctataaacacagttaatagatgtttttcagctgcaatctgtactgtgactggaatgagaaagccttaattcataccatc

SEQ ID NO: 18934 - DNA, 582 bp, Homo sapiens
gcacgcgcgtgagggatgtcgcggtctcgtggtggaacatctgacccttttcaagaggaaggatgaaaactctacataggaacacgatgtgaatggaagaaacctgtcattattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaa

SEQ ID NO: 18935 - DNA, 281 bp, Homo sapiens
tgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagacaaaaaaaaaaaaaaaa

SEQ ID NO: 18936 - DNA, 341 bp, Homo sapiens
aaatcgaggcctgtcgggtcagggcggttcgcgggtgctgtcagagctgggccggggccctaggcaggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagac

SEQ ID NO: 18937 - DNA, 426 bp, Homo sapiens
atctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagcactccccaccgctaccatggmcgaagacgcagacatgcgcaatgagctggaggagatgcagcgaagggctgaccagttggctgatgagtcgctggaaagcacccgtcgtatgctgcaactggttgaagaggcttaaatcaagtgatgcttacaaaaaragcctggggcaataatcaggacggagtggtggccagccagcctgctcgtgtagtagacgaacgggagcagatgg

SEQ ID NO: 18938 - DNA, 451 bp, Homo sapiens
  misc_feature 116: n=a, g, c or t
gcacgcgcgdgarggatgtcgcgggatctctatgaagcaccagaattatcagtgaagaatatattaaatggctcacgggctactgtaaagcatatttctatcgcttgagagtaaanctgctagarccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggtatkccgtttttggcattgttgttagaagcttcttcaacttgagaatatttgaagatgttaaaagagggaaaaaaattccaaccaagaatcatattgatatttaaaactatagtattttcagt

SEQ ID NO: 18939 - DNA, 431 bp, Homo sapiens
agtgagggttttgggattcaagcacagaccaccttcgcccctatgctacaccacctcaggctgtcgggagataggcgcccagtcaaaaggcacatagaagaaagcctacgacttctcaagcattgaagcaagagtggcgcatcggtatgctcaacttcaaactttgagaacagtcatggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatcttta

SEQ ID NO: 18940 - DNA, 424 bp, Homo sapiens
aagaaacaggctgtagacagtggaaagaaacacagggatgggaatgggagggtcgatggaagagcaacccagaatccactgactttgatctgatgttcacctgcagtgccacactcaatcagtatccaagtcctagctgttcacccsatcstcgacagggtaccctgtcccagggccctagcatggcatggccccttggatgattggtagctacstggaagacctcggaatatatttgccttsaccccasctaagagaaagcctccaggcaagtcccccagagaagatagtgaaggcccaggacscttatgaacacaggcacagggccacgctggtgatatctaggaataattgcagggaaaaatgcacccaagcttcctttgggaatcaatctccccctcccactstacagataatgttgcag

SEQ ID NO: 18941 - DNA, 469 bp, Homo sapiens
aaaaaagcgaggacgtgaccgttttggaagcattgttcttttcactgttagtgaggagcggtcaaggatgcgtattaagaaaataactagaagtggccgcatgatgtacctctcaccaatgagatgcctgtcaaggtatacgtgggtcttttgagatcttattcactgatttgaagagttcatgcatcgagccagtagggktgcacatgggtaaaaactggctgcggctaaacagttactcttagaagaaaggaagcattgagagtaaggaacaaatgccaatgatgacaacccaaacactatgtattgtaaatgaagtggacttcgtggtttctttatccaccaataaattaaaagaaaacttacaggaaatggacacagccctggataaatgcaactactaagattcaaccaagaagtaaaaatccttaacacaccaatacaactaatggatttaatcagtaataaa

SEQ ID NO: 18942 - DNA, 325 bp, Homo sapiens
gaggacgtgaccgttttggaagcattgttcttttcactgttagtgaggagcggtcaaggatgcgtattaagaaaataactagaagtggccgcatgatgtacctctcaccaatgagatgcctgtcaaggtatacgtgggtcttttgagtattgtaaatgaagtggacttcgtggtttctttatccaccaataaattaaaagaaaacttacaggaaatggacacagccctggataaatgcaactactaagattcaaccaagaagtaaaaatcctgaacacaccaatacaactaatggatttaatcagtaataaaaagtctctcacca

SEQ ID NO: 18943 - DNA, 149 bp, Homo sapiens
agaaaaggaggggcgtacgcgggcaagatggaggcgactacggctggtgtgggccggctagaggaagaggcgttgcggcgaaaggaacggctgaaggcctacgggagaaaaccgggcgcaaggacaaggaaaaaaaaaaaaaaaaaagc

SEQ ID NO: 18944 - DNA, 438 bp, Homo sapiens
  misc_feature 293: n=a, g, c or t
agaaaaggaggggcgtacgcgggcaagatggaggcgactacggctggtgtgggccggctagaggaagaggcgttgcggcgaaaggaacggctgaaggcctacgggagaaaaccgggcgcaaggtgagaagtgtggagtgagggtcgcagttgaggcgtccagcgttcggggtccgggtcgcgcwtgaggagagcaaagggctaataaggaaagacagctgccgagggcgcgcatscgggcgctaacgcatgcgcgaraagacggcgccctcccacgatgtctggggctgcttngcgtgggactcctctggcgctggtgcggtcgtcgcgcacgcgcggaggggtgggcaaggcagtggtcagcgaccgcagtccatctgactcctgcttcccgggtgttgctcgtgtaggtatctaggggctgcctgtaggttcagat

SEQ ID NO: 18945 - DNA, 524 bp, Homo sapiens
gataaagcgcgccgactgggctacaaggccaagcaaggtacgtgatcgactgcgtggatgcttggataaaattatattcgagaaaagttggaaaccagctgttaggaagacactgctgcctcagtgtctttcttcgcatagggctttggcagaaaaaagctagcaacactggtcagttactgtatgcactgttgtctaaagtggcaagtgtgtcaaaggttacaaatctgaatgagttcagactaaagcaaaataaacagtgtgcctccctgtgtgagtagcctaaggtgcattgaaaaagactgggatgtgttttatttttttctattagatagcattaacttactgttgaagtatttttggtggagtattagtgacaagccattgagtcttaagccttacggcttcctataaaatcactaatttcgtgtktgtttgtgtgtaggttacgttatatataggattcgtgttcgccgtkgtggccgaaacgccagttcctaagggttgcamttacggcaacctgt

SEQ ID NO: 18946 - DNA, 518 bp, Homo sapiens
agttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactggaccagattacagaggggtattgatttgccttgcccccgcccccaccatcacagtgtgtccctgtccagtgttggtgctgtgtggcattgcttgtgtccataggagtccatcaaggcagagcagcagagcgtcaagcagagcgtcaaggcagttcaacccaatggaaatggattgaaagagtgaaagtcactggtctcaaagaatctacggaatttagcattttgaaaatcacagagcaatttttgggtaggtattcacatgcactaaaaaaccaggcaacatctgact

SEQ ID NO: 18947 - DNA, 409 bp, Homo sapiens
aagttcccctgcagttgtttgggctgtcgctgtggctggttctgcggtgtgcggccagccatggagcgctctgggcccagcgaagtgacaggctcagacgcatcgggaccggacccgcagcttgtggtcaccatgggcttcacggggttcggggttcggtaaaaaagctcacacatttgacttggaagcaatgtttgaacaaactcaaagaacagctgtggaaagaagtcacaaaacactgggccaccaggaacacacctgtagcccagcaaagkkgaggccatcgactggctcatcacaacaaggaaggctgtgcaccactgggacccagcagcagctcagcagcagcagtgagagggccttgggaaagacttggagggtttggcttatacaagaccagattacagag

SEQ ID NO: 18948 - DNA, 519 bp, Homo sapiens
  misc_feature 391: n=a, g, c or t
attggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgantagtttcttgtatgaatgtgcaagaggcctgtgaccgaatgctacgtttttatggtagtttaagattataaagtagaaatgcaacaattcccagtttttttggataggtkctaaatttctgagatttg

SEQ ID NO: 18949 - DNA, 469 bp, Homo sapiens
attggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgrttagtttcttgtatgaatgtgcaagaggcctgtgaccgaatgctacgtttttatggtagtttaagattataaragtaga

SEQ ID NO: 18950 - DNA, 468 bp, Homo sapiens
aagtcaacagcaatcgcccatttccaaagccatggtgaaacatctctgtgctaatttcttttgttttgtttcctaattttttttttttggcaggtggtrggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagawtccagaggcggggctcggatgaaccctcgagataagcaatatttgaga

SEQ ID NO: 18951 - DNA, 519 bp, Homo sapiens
aagtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagatggagagcaatacatcatcatctttggagaatttagcgacggcgcctgtgaaccagat

SEQ ID NO: 18952 - DNA, 256 bp, Homo sapiens
  misc_feature 223: n=a, g, c or t
agtcgatctggtcaccaagacagctgttgactaaagcgtggggagcttatacagagtccatatkctggacaaarggaggattcataccctgggatggagagcaatacatcatcatctttggagaatttagcgacggcgcctgtgaaccagatccaagaaacaatttctgataattgtgtggtgattttctcaaaaacatcctgttcttaactgtacaatggcnaaaaagcttttccatgacatgaatgttaactat

SEQ ID NO: 18953 - DNA, 306 bp, Homo sapiens
aaaaaaggaaaagcgtggcctgggtgagtgaaggagggaaaggagggcctcagacgttgtgtctgggattcaggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcagcgaaagcacgttccagccaccaggaggccacctattgtttcaaaataaagactgggttcctctcttggaaaaaaaaaaaaaaaaa

SEQ ID NO: 18954 - DNA, 470 bp, Homo sapiens
tataagttctagcaattattaaaaaaggaaaggctgtctgcaaacaggtgatctcagaagggggtttgtgcctctctaggaaggaagcctcattgtggacatctgggagcaggtacatcccagccttcttgsacatagaaacactacacagcacttcagctgtatgtttgggggccattttaaacagcaaaatcatcaacaggaagcagaaaattgtaaaaattgtggcactaaatagaccatgtaaaggacacatgtttgcaataagaaagctgaaacaagaagggggagtgtcaccttatttgatccagctagaaactcaggtgctggtattccagcaacactcaggcggctgctccaggaggctgcagaggggtcctttttagccgtcaacaaaactggctatggtcacgcccattgcgaaactcattgctgccttcaaggttctgtcaatagaagatactaaagaa

SEQ ID NO: 18955 - DNA, 458 bp, Homo sapiens
aatctggaatgatgatatcaatcaagtgaagcagctatcacagggtctggaacataaaataatcatgaggcccaaaacacttcctgaatgaaagagaacctgcattgaattttgttctgtggtgaatggtacatcccagccttcttgcacatagaaacactacacagcacttcagctgtatgtttgggggccattttaaacagcaaaatcatcaacaggaagcagaaaattgtaaaaattgtggcactaaatagaccatgtaaaggacacatgtttgcaataagaaagctgaaacaagaagggggagtgtcaccttatttgatccagctagaaacgactcagaagctgtaggaatattcaggcacagacaccagacccagcttcatctctaacttgtggcaaaggacagtacatcctgggatgggaccctatgctcccctatgccatttagacagagc

SEQ ID NO: 18956 - DNA, 790 bp, Homo sapiens
attagcatcccttgtcttccgcggtgttgcagacttatcctcagctcaagcgagtttggggcgttatggagccagccaagtctccccttgctggcgtgggtacttgtgcagaaacttcccgaggtgcttctgagactgcacagtgaagaccgccgcaccggagtcagcgctccgccgcggactcccggctgactctgccactctcccaggaggaggcgctgtgcacctctgggtggtttccagggctcggctggcggtagagggagccttgaggttggaaaagatctagagctataatctccgaaaggaagatttgtaatacactgcgagttagaaatgtttttctcactgcagcttccttgtttcaaaaagagaatttttgacagcactgcaaaggcacaagaaaccaggcacagtataaaatatacaaataaaacaggtaccaaggaacttaaaacattcaacccataacgtcgtctaggtttttctgctttaagaaaattgactcaattcttccaagagaataaccctattaaaggctaaaaatggaagctcccagttatgtagaagatatttccatctggatccgtcttagaaagtgaaacaggaaatggcttaatcctagaggagaagataagactggagaaattactggggaaagggcggttaagggctttctgcaagtgcttgagactatccctgtggcaccccctaccacagccctaggaacaatagcataagatccttgcaccaataaatgtcacagaaggatggaaaaaaaaaaaaaaaa

SEQ ID NO: 18957 - DNA, 517 bp, Homo sapiens
acgggcgcgcgcacgccgccttcgccgctggctccgtctgttggggggcgaacacgcgcggtcctcgtcgtgatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcasaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaaagacaatcagtttcagagaaccaggagg

SEQ ID NO: 18958 - DNA, 1030 bp, Homo sapiens
ggctccgtctgttggggggcgaacacgcgcggtcctcgtcgtggtgagcgcaccactcaggctggtcctgggggtggggctgtaggggaaagtgctaaagccgctgagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcacaagttgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaaaaaaaaaaaaaatgcgaa

SEQ ID NO: 18959 - DNA, 419 bp, Homo sapiens
cttcgccgctggctccgtctgttggggggcgaacacgcgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgc

SEQ ID NO: 18960 - DNA, 324 bp, Homo sapiens
ttcgccgctggctccgtctgttggggggcgaacacgcgcggtcctcgtcgtggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttaaatccgggaggcagaggttgctgtgagccgagatcgcgccatttccagcctgggcaacaagagggaaactccgtctc

SEQ ID NO: 18961 - DNA, 379 bp, Homo sapiens
aaaaatcctttgttgacttccttccaccagccctgggaagaatctatcatcccctttcctctaacacccctaacccctttcctctaacaccaaatgtggtgttccatcaccacatttatagaaaaatatatattacaattattggtttctatgtctgtttchagttctcctcaacttgctcctcaagggtacatctggacacaaaaaaggacaccagggatgtgtgcacatggaggaaagagcatgtgaggacacatcaagacagcctctatctacaagccaaagagagaggcttcagaagaaatgaacctgctaacaccttgatcttggacttccaggcagtactgtgagaaaatgaatttctgttgtttaaaaaaar

SEQ ID NO: 18962 - DNA, 403 bp, Homo sapiens
aaaaatcctttgttgacttccttccaccagccctgggaagaatctatcatcccctttcctctaacacccctaacccctttcctctaacaccaaatgtggtgttccatcaccacatttatagaaaaatatatattacaattattggtttctatgtctgtttccagttctcctcaacttgctcctcaagggtacatctggacacaaaaaaggacaccagggatgtgtgcacatggaggaaagagcatgtgaggacacatcaagacagcctctatctacaagccaaagagagaggcttcagaagaaatgaacctgctaacaccttgatcttggacttccaggcagtactgtgagaaaatgaatttctgttgtttaaaaaaaaaaaaaaaaaaaaaaaaaaaaaaaa

SEQ ID NO: 18963 - DNA, 384 bp, Homo sapiens
aaaaatcctttgttgacttccttccaccagccctgggaagaatctatcatcccctttcctctaacacccctaacccctttcctctaacaccaaatgtggtgttccatcaccacatttatagaaaaatatatattacaattattggtttctatgtctgtttccagttctcctcaacttgctcctcaagggtacatctggacacaaaaaaggacaccagggatgtgtgcacatggaggaaagagcatgtgaggacacatcaagacagcctctatctacaagccaaagagagaggcttcagaagaaatgaacctgctaacaccttgatcttggacttccaggcagtactgtgagaaaatgaatttctgttgtttaaaaaaaaaaaaa

SEQ ID NO: 18964 - DNA, 527 bp, Homo sapiens
cactaatgactcaccttagaaggaaaagaaaaattttaatttacttaaaaaattttttttttgattgaatagataattgtgtatatttgtggttaattattattttacactccagacctatttctacacctgtagggaagaaacttaatcactgatatcatcagcctgtcagataccactgatatcttcagtctagttttaagaaaaactaggactaagaagaagtatataatcaagttcaagctaatcatggccatttttaaattacttggtcttttttaatactttttcccagagcaaccttctaaatggaagggcaaagcctcaactatctaaaatgcagcttttaaggactcttagatgtatgatatgccttatgtacaggagattccatctataccttgacacccacaccactcccacccctgttctctcttccaagaaggtttttggcagcaaatagttctctttaattattatatttaaatatttgtatatatttaattcacattagggatacaactaag

SEQ ID NO: 18965 - DNA, 458 bp, Homo sapiens
cactaatgactcaccttagaaggaaaagaaaaattttaatttacttaaaaaattttttttttgattgaatagataattgtgtatatttgtggttaattattattttacactccagacctatttctacacctgtagggaagaaacttaatcactgatatcatcagcctgtcagataccactgatatcttcagtctagttttaagaaaaactaggactaagaagaagtatataatcaagttcaagctaatcatggccatttttaaattacttggtcttttttaatactttttcccagagcaaccttctaaatggaagggcaaagcctcaactatctaaaatgcagcttttaaggactcttagatgtatgatatgccttatgtacaggagattccatctataccttgacacccacaccactcccacccctgttctctcttccaagaagggtttttggcagc

SEQ ID NO: 18966 - DNA, 516 bp, Homo sapiens
cagtaatgcttaaataacatgtttattctcacttcagctctgttgccaagaagaaccttcagttcatctctaaaagcatttattggatgcttactatatgctgaatgctagagttatgaaaatgaatgacctagtccccacctatcaggaacttaaaaactagtggtgagggatttaaacaaaacttcaatatagtatagtaaaatgtattatagaggtatgccttgcagttatggaaatcaaggaagagcaccttacctaagttgagggttcaaagaaggcctcttagaagggatgttccctgaaccaagtcttacacagttagcaagaaaaaattgggaagggtatataaacaaaagcagataggtgtgatatttacatggaagtataagcaattctgtgatagagtacaaagtataaaatgaagattggcagatgacattggagatagctatgtgattattatccttataatccatgttaaggaattttactttatcttctaggtcaggagac

SEQ ID NO: 18967 - DNA, 449 bp, Homo sapiens
catttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgaaaaaaaaaaaaaaaag

SEQ ID NO: 18968 - DNA, 496 bp, Homo sapiens
aaggaacaatgatttacaaacagaaatacaataccttttcaaattgccagtcaagagtgaagtatgccaagaaaaaaggagaggctcctcaataaccctcaagacataatgtcattttctctcctgaggatgaagactctctatatgctgaatatttattagtctgctgggtcacctgctagaaaacagacaattctccagcaacttcaaacactcttcttcactgaactacagtttggtatgagacgtcaaaggataagaatgtgcatacctaaatggtcaaatgaagatgaatgttccatatggcttttgcccatactgcccaagactgtgttaaaaactaaatacatcaggatgctctaagccactgaagagccatgtttgccagtccattatactgggcttctctggttatacaaagggacagctaatgaagatattctgttgatataaaagcagtctcatggacagtaatctttctatatcctttaggcag

SEQ ID NO: 18969 - DNA, 569 bp, Homo sapiens
aaggaacaatgatttacaaacagaaatacaataccttttcaaattgccagtcaagagtgaagtatgccaagaaaaaaggagaggctcctcaataaccctcaagacataatgtcattttctctcctgaggatgaagactctctatatgctgaatatttattagtctgctgggtcacctgctagaaaacagacaattctccagcaacttcaaacactcttcttcactgaactacagtttggtatgagacgtcaaaggataagaatgtgcatacctaaatggtcaaatgaagatgaatgttccatatggcttttgcccatactgcccaagactgtgttaaaaactaaatacatcaggatgctctaagccactgaagagccatgtttgccagtccattatactgggcttctctggttatacaaagggacagctaatgaagatattctgttgatataaaagcagtctcatggacagtaatctttctatatccttaggcagccacaatactgcctgtcaaatataattascagcagaagaacagaaaactaacacttacctattaccttgttaac

SEQ ID NO: 18970 - DNA, 477 bp, Homo sapiens
  misc_feature 455: n=a, g, c or t
aaaaaatcgtttcaggattggaaaggaaggtaccaaaatgattggagagggcctttccccgtttcactaggcacttggagaagctgtgacagagagctggacacccagcgcgtgcggaccccgtgcgtatttccccggagtccgcgttccgtgaaagggagaggggtgcggttagctccagggattctctagccctggagccaccgctgatttgcgcackwagtttgcctgggggtgataaacgggcgtcgtctctcttcaggagcgccaacactaccaagcttccccctgcaaaattcagaaaggatgcgctttggtgagaacttggctcagccttcccgtggcttgggagatgaggttggagtgagaatgtcaccagacctcggaaggggacataacggtacctcctagtcccaggacacgggtacgtggcggaggtggggtgtgggaggttngtgggaagagcgcaggttactg

SEQ ID NO: 18971 - DNA, 607 bp, Homo sapiens
ccagactgckagcgsmgaagcgtagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccrtcaacctcatacgtatctacctggtctctgatcgaagctaccgtaatgtgttcttgaggtcacatgatttg

SEQ ID NO: 18972 - DNA, 501 bp, Homo sapiens
gagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagarcgsttkgraaatacccaggragkttraraggagtttamcagaaagggcgcacgctggattggccmmaaaatcgawttactgaaggccactactgattaggacacttatggagaacgtgggtagcactgaagcagcattctagtttcagtgccgtcaacctcatacgtatctacctggtctctgatcgaagctaccgtaatgtgttcttgaggtcaacatgttttgtg

SEQ ID NO: 18973 - DNA, 415 bp, Homo sapiens
  misc_feature 136: n=a, g, c or t
agagatggcgtaacgggaatagttttcaacgtctatttcattccctgcttcagaggacctctttaatctttgattttggtccctgtttctaagaaaagcaactgaaaaggtcgtaataccgcccctgagaaaaaangagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaagaaattaagaggag

SEQ ID NO: 18974 - DNA, 474 bp, Homo sapiens
agatccaagaggatgagacaaagtccccatatctcaatgaaagatcgtcaaggtcacactgaagaagaccatgtgggatgggagagagacatagtggtcacatttgagaaaggccatctgacagatgggagaagctgaaagggctgcagtaagcaaatacactttggacgaaaatttttcttaagatctatctttartacacagatttctatgaattagctccagtwawatttattttcaaccttgtcattacagaagtamcatatttcaaaacacttgacagtttacaaagtactcttaattgatcatcataataagcctgctaattattaggacaaaatattatcacccacactgtttagacaagaaaactaagacccaaattctcatagccaaaaaaggagcatgttcaggatctgagtccagaattaactgttctttctacagaaacaaaccatctattgaacatgccat

SEQ ID NO: 18975 - DNA, 449 bp, Homo sapiens
atgaaaaaatctaaattaatatcttgtgcccaaatccaacattccaatggagaggtaaggaaagaaagggcagcagtggctcaggtaagggagacccatctgtggccaccatagctccaccgtctctcactgtgggtaatggctgtgactcagttttgccttctgtcatttgtaagctgcctgctttctgtgtctgcctatccatctgtgcaaatggattcagtgtgattttaaatctgtctgaaaatgaaattcagttgcaagtaaaaacttctgtggatacatcatggtctgaggtgagctctaggagcttgcttttacaaatgagaaagcacaagtgcagacacttggtcacctcctctatgcatgcttagcctgcaaaagtgcaacagcaatgaaagcacaactttttctcatgcctgaatcattacaaagaggcaaacggaaag

SEQ ID NO: 18976 - DNA, 482 bp, Homo sapiens
tctttaaacatagaggtaccaccacaagggatgccctactctctcgcagctcttgaaagcatctgtttgagggaaacgtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattc

SEQ ID NO: 18977 - DNA, 467 bp, Homo sapiens
  misc_feature 410: n=a, g, c or t
atgcggccctggaaactgtgagtttggggattgttgygtccmmtawcyggacycagaagggacttccctgctcggctggctytcggtttctctgctywcctccggakaaatmacrgsgtctyccgcgccgtcatggmgctcccgkccgyckcgagygtccctttccttccyggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacknaaatcatgtcgtaatcctccagatcctgtgaatggcatggcacatgtgatcaaagac

SEQ ID NO: 18978 - DNA, 659 bp, Homo sapiens
taaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaag

SEQ ID NO: 18979 - DNA, 451 bp, Homo sapiens
ttagagcttatgtttgaatttttacttaaatgtacttaaagactaccttaaagggaaaactaaaactgaattttaagaaaggaagctaaaaacaaaagcttaataataatctgacacttttatcctttcattgattgattgaatcattcattcattcatgaaatatagattaagtgcctagtatgagcaagcctagtctccatactggggctatagccatatgcaaaaactcacatgttccctgagcccatggaattgatctacttgaacactaaataaacacaaaattgtgtttatcacaaatttgtgtttactacaaaatttctaagattttgaagtgctacaagaactctgtgggcattttttctttgaagattttgttcgcttgctatgaattaccaagggtcctatctgataactgtgtgcttctcactttgatttccctgactgt

SEQ ID NO: 18980 - DNA, 485 bp, Homo sapiens
aacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtattttwattttttgaactttatttaaagcatttgtgatgacatgttcaacttttgcatgtatgtagcctttgaagtaaaaataaatrggaatgttaggcycmcgcaaaaaaaaaaaaaaaa

SEQ ID NO: 18981 - DNA, 463 bp, Homo sapiens
  misc_feature 401: n=a, g, c or t
gaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaagggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgactacctgmcaccactaccacnacccaacccttctcactctcctcagtgctagcactttgtattttttgatacttttatacttg

SEQ ID NO: 18982 - DNA, 493 bp, Homo sapiens
taacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggcttgaacgatagaaatatgcagcatsaatatatgcttatatttcatttt

SEQ ID NO: 18983 - DNA, 378 bp, Homo sapiens
aaaaaggaaaacgcgggcttatcgtggcctttaaaatccggcttggtgagcttgggtcgcctctgaaggagaaccattttccatctctttcatagttttttccccctcagcgtggtagcggtattctccgcggcagtgacagtaattgtttttgtctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaaaaaaaa

SEQ ID NO: 18984 - DNA, 507 bp, Homo sapiens
aagaaagttctagtggcttgaggtatccgcagagcgccgggtggcgggaggaaccgttacgggaactgaagttgcgggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattccggscccatccctcacccccaccctcacttt

SEQ ID NO: 18985 - DNA, 509 bp, Homo sapiens
gaataatgtgagtgcgcttgaaaaagagacctcctgctccgcgggctcggggcaagagccgcaggctaccttccccgggcaggggcgctcaacccaaccggctccagggcactgatctgcgatttccttctggttggctgtcctgcgtgggtgccaagttccacacatttaatgaataagaagctcgccagtgaggcaaactccagcattttatatttcatctgcccccagtgacttcactgtaggaagaggaaatgcagaaaaacaaacgtcttgaatactgaaagcctgttattcaaagaggttagcagtagactgttggaagtaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgc

SEQ ID NO: 18986 - DNA, 433 bp, Homo sapiens
gcttagcgccccaggccgcccctgacactgaacgccgcttgtcccctccggcttgccgtcctcgcagccatggcgscgscgcgctcccagcatggctgtctctgcagtcgagggcaaggactctgcgtgcattctccactgccgtctactcggccactccggtcccgacacctagcctgcgtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtct

SEQ ID NO: 18987 - DNA, 479 bp, Homo sapiens
agtaagtacgaatcggccttaggttccctgcctcaagaccctattctcctgcctcacttttagctaagggttattacaaaagagtcagaaagttaagacaaaatatgaaagtttataaagtaaaaagagttacagtgagctaagtataacttattgaaaacatttttttaatttagtatagcctaactgtgtttatacagtctacagtagtatacagtaatatcctagacctccacattccctcgccactcactcactcactcaccgactcactcagagcaacatccagtcctggaagctccattcacagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaa

SEQ ID NO: 18988 - DNA, 489 bp, Homo sapiens
aagaaaaacgaggggttgcaactgccacgcagcaactgccacacagaagaaggagggactgcaactgccatgcagcaactgccacacagaaaaaggaggggttgcaactgccacgcagaaaaaggaggggttgcaactgccacgcagcaactgccacgcagaaaaaggaggggttgaaaagggagtagcttctgatattcagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaacaaccaatctaaactggcacagtgcagaggcaatcaacagagaacataatattgatagaatgcctgacgcttttgattgtattcacaggaaacataaacaattggaagacagtttatg

SEQ ID NO: 18989 - DNA, 478 bp, Homo sapiens
attttgtttctggactatctccctgcaactttcaacactactgaccagcgttccttcctgataagagaccaccaactatggagtggtactggcctgtcaatggaggatacacagtgagggtttttgtgtcctgtgtttcacgttttgacattagagagccaaaaactccatcctgggatcatgctgaagcaaccattttttgaacatgggacccgtgaaggggtttgaagctcaattgcacatgtgcatgtttctcctgtcataaatattcatgactcctcctatagtttattgattacctatatttggccacccagtctggcataaattcctgtcttatccttcctactcctaaactgcctgtatttggcttttggttgcatgctatgcttcctagcctttcagaatggccactctgcaggctgcttccttttataagaaataaagctcttatttccaaatctaaaaaaaaaaaaaa

SEQ ID NO: 18990 - DNA, 460 bp, Homo sapiens
actctaccattttgtttctggactatctccctgcaacttattatagaatagtttctgcttgcaaccatgaatcctgactgctacatgtggaagtgtgttctacaggactaaggcagaggctgaggcatcatcagcctacctgagatgatggaataattcaaggatcggaaagtgaatcaaagcagaatgcatgggagaaaacaggacagttttttagtctgctcatcaacatcattttatccgcattgttctcaaaaatctgaacattaagacaactcaagtgtgacctgaccagttcacagaacgctgagaatattacttagtacaatctcatcacaatacttctattttgcaatacaagatagccatattatactttgcttatattaagtttgtaactatctaaaatctccaagttttttagagcaatctacttccagataacatgtctattttatac

SEQ ID NO: 18991 - DNA, 528 bp, Homo sapiens
caatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaattwcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgmacagaattggagtattttctttataatttcttgaacaggcaaatgaaagcttattatagaatgcatgtattttcttttatctttggracatcagcaccaagtaatattgctgca

SEQ ID NO: 18992 - DNA, 506 bp, Homo sapiens
aaaaaaccaagtgttcatatgggatcaggcaaaagcaggtcctgaaggcaggatcctgaagatcaggcaccacctgacagccgtcatccgaaaggaaagaaaagaaaaaaggtacagcgcatatccacatcccaagctagtaagatgcggascagactggaagcagggagtctggaaaggggcagagagagtggagcagagaaagactcactgcagtccaaccagatggccaattaacagagcagtcaagaaagaaaccgcagtgaaaaagcttgtcagcacgctgtggctaaggctcctcatccaggacaggcatgaagcagcagatgcacacacagtgacaggtctgctgagaacagctggccactcaggagcccaggagagtcaccaacacagccaaggacaaaggtggagagtcccttaaacatgcctgactctgagatgtgtgaagtcgaacaggtagtgggaaataagaattatttttatggttagggaatagaaaaaaa

SEQ ID NO: 18993 - DNA, 377 bp, Homo sapiens
  misc_feature 265: n=a, g, c or t
aaaaaccaagtgttcatatgggatcaggcaaaagcaggtcctgaaggcaggatcctgaagatcaggcaccacctgacagccgtcatccgaaaggaaagaaaagaaaaaaggtacagcgcatatccacatcccaagctagtaagatgcggascagactggaagcagggagtctggaaaggggcagagagagtggagcagagaaagactcactgcagtccaaccagatggccaattaacagagcagtcaagaaagaaaccgcakganaaagcttgtcagcacgctgtggctaaggctcctcatccaggacaggcatgaagcagcagatgcacacacagtgacaggtctgctgagaacagctggccactcagggagccca

SEQ ID NO: 18994 - DNA, 367 bp, Homo sapiens
aaaaaccaaagttgttycatatgggaycaggcaaaagcaggtcctgaaggcaggatcctgaagatcaggcaccacctgacagccgtcatccgaaaggaaagaaaagaaaaaaggtacagcgcctatccacatcccaagctagtaagatgcggascagactggaagcagggagtctggaaaggggcagagagagtggagcagagaaagactcactgcagtccaaccagatggccaattaacagagcagtcaagaaagaaaccgcagtgaaaaagcttgtcagcacgctgtggctaaggctcctcatccaggacaggcatgaagcagcagatgcacacacagtgacaggtctgctgagaacagctggcc

SEQ ID NO: 18995 - DNA, 188 bp, Homo sapiens
aaaaaccaagtgttcatatgggatcaggcaaaagcaggtcctgaaggcaggatcctgaagatcaggcaccacctgacagccgtcatccgaaaggaaagaaaagaaaaaaggtacagcgcctatccacatcccaagctagtaagatgcggmgcagactggaagcaggggagtctgggaagggggcagag

SEQ ID NO: 18996 - DNA, 543 bp, Homo sapiens
aaaaaccaagtgttcatatgggatcaggcaaaagcaggtcctgaaggcaggatcctgaagatcaggcaccacctgacagccgtcatccgaaaggaaagaaaagaaaaaaggtacagcgcatatccacatcccaagctagtaagatgcggaccagactggaagcagggagtctggaaaggggcagagagagtggagcagagaaagactcactgcagtccaaccagatggccaattaacagagcagtcaagaaagaaaccgcagtgaaaagcttgtcagcacgctgtggctaaggctcctcatccaggacaggcatgaagcagcagatgcacacacagtgacaggtctgctgagaacagctggccactcaggagcccaggagagtcaccaacacagccaaggacaaaggtggagagtcccttaaacatgcctgactctgagatgtgtgaagtcgaacaggtagtgggaaataagaattatttttatggttagggaatagaaaaaaaaaaaaaaaaaaaaaaaagaaaaaaaaaaaaaaatgcgaa

SEQ ID NO: 18997 - DNA, 347 bp, Homo sapiens
aaaaaccaagtgttcatatgggatcaggcaaaagcaggtcctgaaggcaggatcctgaagatcaggcaccacctgacagccgtcatccgaaaggaaagaaaagaaaaaaggtacagcgcctatccacatcccaagctagtaagatgcggascagactggaagcagggagtctggaaaggggcagagagagtggagcagagaaagactcactgcagtccaaccagatggccaattaacagagcagtcaagaaagaaaccgcagtaaaaagcttgtcagcacgctgtggctaaggctcctcatccaggacaggcatgaagcagcagatgcacacacagtgacaaggtct

SEQ ID NO: 18998 - DNA, 518 bp, Homo sapiens
agtggcaccagcacttccggtacgaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccrgttccycatcatgtccgaactgactaaagagctgatggagctggtgtggggcacaagagcagccccggtctctcrgacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgac

SEQ ID NO: 18999 - DNA, 533 bp, Homo sapiens
aaatctgaaactttataatagttttattgttggtaatttaaaagctgttttatgtatagtgcagcatcaagcaaattagtatgttcatggtattagaaactaagactttcaggaatagatatggcatacaaatataaagtcaaaaattaaggattttttaagttttagagtgatttatttgggttttattttggagtatggaaatgtggaactagatagaggtggtagttgcacagcattgtgaatatactaagcatgactgaattgttcactttaaagtgtttacttttatgttatatgaattttgcctcaataaattaaaacaattttgttaaagacataggagtctggctttgttcatagcaaaacgggttgtattagactatttctcctgtgttaaaaattatgaaccctcgataaaatacgaaaaaaggtatttgaaggcctagagcaaccaaaagcaggcagaaactagagggacgtcaamccttaaaagaagggratcatactgggtgtgatcacatttatatagc

SEQ ID NO: 19000 - DNA, 190 bp, Homo sapiens
acttccggctgtgtcggcgcgcgaaaaaaggtcctgggttggaatgtttgtactggtctgtggcggtggttgtcggctgtcctgccaggaaaactcggcactgactatcccactgctgatgctgtaaaagaggtccttctgctatgacgcaactgtggttcctctggttctggggacacttaggcctcgc

SEQ ID NO: 19001 - DNA, 199 bp, Homo sapiens
  misc_feature 88,183: n=a, g, c or t
acttccggctgtgtcggcgcgcgaaaaaaggtcctgggttggaatgtttgtactggtctgtggcggtggttgtcggctgtcctgccangaaaactcggcactgactatcccactgctgatgctgtaaaagaggtccttctgctatgacgcaactgtggttcctctggttctggggacacttangcctcgcgtgccgatt

SEQ ID NO: 19002 - DNA, 822 bp, Homo sapiens
aggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgctggaggccccagagcttccagtaaaggtgaacccgacgaagccccggagaggcyttcgaggtgacgctgctgcgcccggacggcagcagtgcggactctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaakttactggatttggtttaataaaagttgaaataaagaaaaaaaaaaaaaaatgcgaa

SEQ ID NO: 19003 - DNA, 354 bp, Homo sapiens
  misc_feature 348: n=a, g, c or t
gctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggaagnctttcg

SEQ ID NO: 19004 - DNA, 415 bp, Homo sapiens
aagttctagtggcttgaggtatccgcagagcggccgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcctatgttgtccttvgccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagcccgagta

SEQ ID NO: 19005 - DNA, 407 bp, Homo sapiens
ctttaaatactgatggggaaatatctctaagatggaacagtactgggaagaaagttgatgtaaaaccatatatattataatttgcataaaaaagtaaaatttttcttgtgtatgcattaaaaaattatagacacaaggctacccaagaaaacttaagatagaggagacaacagtgaagggtcacttttcatggtgtatatttttatatcttatctttgcatatgtgaatatattaattattccagaatgtatgtgtgaaatatttgacattaaaaacatgtaaaattggccaggtgcggtggctcatgcctgtaatcccagcactttgggaggctgaggtgggcagatcatgaggtcaggagtttgagaccagcctggccaatgtggtgataccctgtttctactaa

SEQ ID NO: 19006 - DNA, 701 bp, Homo sapiens
tatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgkaactgctgtctttgcaaatggagtgttttctagtgttttaacaataaacgtaatactgactctagctttgagataaattcttttaaaaatattattcagggagaatatttgtttcctawcttcctgtgtatagtattgtaataaaatctctgttaaaaactaaaaaaaa

SEQ ID NO: 19007 - DNA, 508 bp, Homo sapiens
aagaaaggatattcttagataactgcctcctgagggtgattctggttttgctcactccacggagatggacctggcagaggcttcaacaaaaaagtcaaaaccccaagctcttgggaactgacgtagaaggaagcaggaagaaggaagatgaggcctggtggagtttcttgactggaaacaattagctgcattgttttttatacggtttctccagctgcaccctctttcctgagcattgaaaaatacagatgagaagcagagggaggttgtagtttctatttggtcacagagagtaatcaagtggaagccagatcaccatttacaagaaagactgaatgggagatttggacatgtacgattctatgagactgtgtgaaatgtgtattcacatagtactctgttaccatagtaaccagtcacgtcaggcttcctaggagtctagggaggagctgtcaactttcacaactagttcattcacaaacaacccttsttacaaaatgctttgtga

SEQ ID NO: 19008 - DNA, 478 bp, Homo sapiens
aaacatattagacccacctgaaaataatatagccaatttctaggtaatcttactgctttgtgggtttctttccatgtacatctacctcttccagctgttttaagttttctcaagtctgtgcctatgaaatctcatccaacttttgattattcatggattgattatccgctttttttttgcttttttgctgccattgctatgcctggtctcgtctgcatcaaatatactacatatcagcaactttagagaatgggttcaacagggagtggagagtgaagctaatgtaaaatagtttagtggcagtgggaatctttggacttcatttacctctctcattatttctattaccatggataaaaaagtcagctgctacgttgatatcccttctatgagcacattcttagcagaagaaaacaatccaactaccaacacccgactctattggtgcatttaaaatgtgattccattttttcttaca

SEQ ID NO: 19009 - DNA, 508 bp, Homo sapiens
tcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagata

SEQ ID NO: 19010 - DNA, 436 bp, Homo sapiens
taaagatttttataagtatgttattttgcataaatttaaaaatggatttaccttaaaaaagtgacataaaacttcagtcacaaactaaatgcaaaaatttattttatattcttgtactaaaaatcacaattttgggctgggcatgatggctcacacctgtaattgtagcattttttgaggttgaggtagaaggattgcttgagcccaggaatttgagaccagcctgggcaacatagtgacactctgtctctacaaataaaaaagaaaaaaattagtttggcacgttggtgcacacctgtggtcccagctacttgggaggctgaggtgggaggattgcttgagccggggaggttgaggctgcagtgagccaagattgcaccactgcactccagcctgggcaacacagtgagaccctgtctcaaaataaaaaaaaaaa

SEQ ID NO: 19011 - DNA, 481 bp, Homo sapiens
atagtcgcagattctgtgtgaacatttggttgataatttaatggaacaatggttctttgggagatgccattagaacaaaatacctgtgatggagacaataataaagactgagtcaacagaagcaccgccactgaactttcaacttcctcaagaagtttggaagcaagattgggtatcagtgatgggggcttgggggatattaaaaaagtgatacatcttttactggaatttcacagtttttgtcaagggtctctccactcagttctctgggaagaggcacaatttaaacagcgtaagtgccaaagatgaggatgtagatgttctctactgtctcacagaatcaacctctcctcaccgatcaagtcctcaggggacatctgaaataatcctaatggagggtgctgtcagccgccgctgcacctgctaaatgtcttgagatccgcaaaggctcacctgaatgctttgcacagttgcctctgag

SEQ ID NO: 19012 - DNA, 483 bp, Homo sapiens
  misc_feature 141: n=a, g, c or t
atttaccagagggagccagggctgcagctcatctgtttgcggatcagaacccgagctgttcttgtggctgcggctgctaactggctgcgcacagggagctgtcaccatgcctcactcgtacccagccctttctgctgagynaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgggaccctctaccagaaagatgataatggtgttcccttcgtccgaaccatccaggataagggcatcgtcgtgggcatcaaggttgacaagggtgtggtgcctctagctgggactgatggagaadccaccactcaag

SEQ ID NO: 19013 - DNA, 448 bp, Homo sapiens
  misc_feature 172,430: n=a, g, c or t
atttaccagagggagccagggctgcagctcatctgtttgcggatcagaacccgagctgttcttgtggctgsggctgctaactggctgcgcacagggagctgtcaccatgcctcactcgtacccagccctttctgctgagcagaagaaggagttgtctgacattgccctgcgnattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgggacsctctaccagaaagatgataatggtgttcccttcgtccgaaccatccaggataagggcatcgtcgtggggcatcaanggttgacaaggggtgtgg

SEQ ID NO: 19014 - DNA, 428 bp, Homo sapiens
atttaccagagggagccagggctgcagctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattwtcttcmatgagaccctctaccagaaagatgataatggtgttcmcttcgtccgaaccatccaggataagggcatcgtcgtggggcatca

SEQ ID NO: 19015 - DNA, 484 bp, Homo sapiens
  misc_feature 142: n=a, g, c or t
atttaccagagggagccagggctgcagctcatctgtttgcggatcagaacccgagctgtgcttgtggctgcggctgctaactggctgcgcacagggagctgtcaccatgcctcactcgtacccagcccttttctgctgabsnaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaag

SEQ ID NO: 19016 - DNA, 220 bp, Homo sapiens
ttattgtggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaag

SEQ ID NO: 19017 - DNA, 484 bp, Homo sapiens
gaaacggccactccaggctcaacctatccatcccggcctcttcctaagaccaaggcgctgctgactcaaccctgcttccagaagcctagggttaacatctgctccttcctcctgtttgcattcagtgaaatcctctcctctcccaggagtttccacataaaacctgsctctttgtttattaagaattgtttacagaactctcaagcagcaaaggcaaagtacagaagataaataagagcaagctggccggtgcgtgcgactggatggacaacatctttacccacatgtctgcatcagctctgcgttgttcaccgacaaatcccgtgtctggaagagtcctggcaggctgcacgggctggagagagagcgagctgacaccaacaccaggcagagtccaccatgaaggcaagtggcagtgtcccaaggagagcccgctggccaggagggcaccgcaagcttggacacagcaggggcactggagatg

SEQ ID NO: 19018 - DNA, 482 bp, Homo sapiens
  misc_feature 140..141: n=a, g, c or t
atttaccagagggagccagggctgcagctcatctgtttgcggatcagaacccgagctgtgcttgtggctgcggctgctaactggctgcgcacagggagctgtcaccatgcctcactcgtacccagccctttctgctgaknnaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccagtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaacaccactcaag

SEQ ID NO: 19019 - DNA, 428 bp, Homo sapiens
aataggtgtgcccatggatatagattgctgtcgtcggatgataattagtgaagttaaggatgtcagggaactctaaagccaggttggtacattattaaaagccatgggccctgacatcacrcatgatgattataatgtgaagagacgagactgagactataaagaaagaccaggagtgagctaacttgaatgataccaaggaagatgatataatatgaaggtaggagcctcatgagagagaagaattttgcttgaaagatgaaaagtaatagtttagaaggratcacaatgtttgatgattgatagtattccaacaccattgccagaytccatggtagatgraatatgggaaattaagttcattcatctcaagaaagctaccagtaaaaaagtggccttgaacttggataatacatacaccttatcac

SEQ ID NO: 19020 - DNA, 497 bp, Homo sapiens
tgtgaatactgagctgctcggctatctgcaggttttccctggcttgctggaaagagtgattgatcttttgcgggtgattcatgtagctggaaaagaaaccacaaacatcttcagtgattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactaca

SEQ ID NO: 19021 - DNA, 325 bp, Homo sapiens
acagataaggaagctgagatgtagagctgaagtgtcttgcccaagatcatttgtctagtaagtgataaagctggaatttgaacccaaagagaatagggctagaggctttctctctactctcccctggttctccaaagtgagctacctttccatttctatggctagtttatgaaatacagtcatgaaacaagagctctacaattatatgtcaaaaagcagaagatagaagtaggttaatcctgcttttggaaaaaagtgttcagaatatacattaaagtaatactaacgtaaatctgtggacatgaaaaaaaaaaaaaaatgcgaa

SEQ ID NO: 19022 - DNA, 490 bp, Homo sapiens
aaaaactagtatataaaacagaatggagttttacttctagcaatagctcctattggaccaatcttcctgtagatagcatttataactctcaacaaactatgtaaaatgactatctgaaggtactacagtctaaagcatgcagaaatgggaaggaaattgatactgagtgaatttcccatttttacagcttttcacttgaagggatgacatatttcgtactagctgggtcaactagaacttggataaaaatctgtggtcttattatcttgaagaatgagaggacagttctacatgaattagagttcagggttaccacagcagctggaagataaaggaagaaatccaggaaaagagagagcaacagaggaggagccccaaactctatgtataaactctgcttaaaaaatctctggatgatccctgaactacacatgtatggggcagattgaaagcatatcagctaaggctatataaagatttcagctctttc

SEQ ID NO: 19023 - DNA, 509 bp, Homo sapiens
attccaactttataaactagcaaaaaagtgtttgcttattccaccagttctactgtgacatactcgagtataaagacatgtagcaataacggggagtggggggggagtctcatagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtactttagtttgtacgtaggtacagttggagcactatatgtactctctggactactttggacagaagtaggtttttgaatgtaacaagataagtcacttgag

SEQ ID NO: 19024 - DNA, 514 bp, Homo sapiens
attccaactttataaactagcaaaaaagtgtttgcttattccaccagttctactgtgacatactcgagtataaagacatgtagcaataacggggagtggggggggagtctcatagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtactttagtttgtacgtaggtacagttggagcactatatgtactctctggactactttggacagaagtaggtttttgaatgtaacaagataagtcaactttgagttg

SEQ ID NO: 19025 - DNA, 501 bp, Homo sapiens
tgatttagataattataaatgttataaggaaaaataactgggataaggaaaggtagctattttaattggataattaggcatacttctctcatgcataacaaatattctaattttgttcaatccataccaatattttttggattataaaggtaatacctttttttcaactccattttttctaaaaaagttagttatattgtttattattttacggaccatgaaacatgatggaaaccggggaattgagatgtggccagttgttagtttgtaaaatgacatttaaaaattaccatctactcatcacctcatcatttgacaaaacaatgcatgttttaacaccaaaaagtaggaaagatgtaatcccagaatagagggcagttgaatacgtttagtgttttggaaaatttgctgcattatctgaggttttctccttttcatggcctatgagaacttcatcagggactggttctggtcaggggctggcatccagttccacagatc

SEQ ID NO: 19026 - DNA, 293 bp, Homo sapiens
agtcacagcctcagccgcagcggccgtgctacctaggtgatagcggascytgggtaggaagcaattgttctcaaacttcactagccccgtcggcgcggacgcttgtcgagaatgcagattcctgggtactgccagatacgaattgagcataccacaaaaaagttctcattttgtgtcctcccatcccattctcctcactaaccaaaggctaggaattatctgtgaatgtaggaccactggatttgcagtcttcatctgacactgtggatagtttctaggaatgaaacagatat

SEQ ID NO: 19027 - DNA, 470 bp, Homo sapiens
aaatcggttagcgcgcggtacttatatggcagtatgtgtgcgagtgatgccgaggttgtgagttcgagcctcacctggagcattgttttccaacccaaaatagcattacttgaagtgcctttccccctgtaatccgactccatcgtctttaacgtgtttggaattgtgtacacagtttattgttattggtttccttagcctttttagaaccaagcaacgccaattaccaacaaaatccgttgcgccgcagatcatcgatcatcgttcctcggggagcccctggcacatacttagtgctaagaaactcccatcagctttgcttgaggcaaatgcaacaatatttcagagtgaggattcagccaaacatctctaagaagaaaacctctggacacagcaggacacagaaatactgaaatctccagcctagggcaccatccctcaagttaaagcccaggcagtaagaaaacata

SEQ ID NO: 19028 - DNA, 440 bp, Homo sapiens
ttaatttgttcccagtggttgaagttatttgccaacaattttactgtttctcttcatctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggggagtagtactttacacaattgcctctcccccacaaatcataattgt

SEQ ID NO: 19029 - DNA, 550 bp, Homo sapiens
catcataaggaaaacgtgttgcgcatctctagtttgatatgagctttagtatctccccactacagtgcgagaaaagtcagggcaaaggattgaaaagaagttcacaacaaaaaagtttgaacacaagcaaacctgaaacagatgcagggtagtagatcttaagggtgcgttgctcactccagggcctgctgccacccagatggctggcaaacaccaggactccgaacacaacaggattcagggattcagacaggagtcttgctctaccaattattataggatcttagatgcctttccagtaaagctaacaaaaaacaaaacaaaataaaaccatatccaaaatactaaacagctgtctccaagatcagaaggcatcagaaaagaccctcaagagttgtctaatcccagaggaagatcttaagtggggatgtgctcacagcagaaaccttggaaatttcagggagtgaaattttattgtcagaactttcaataaaagtgtagccacagatcctgggagcattaaataaaaattaccaacaagctgtcttac

SEQ ID NO: 19030 - DNA, 470 bp, Homo sapiens
taattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcmttaaaaaatctcttctatcccagacatgggccaaggtgctgtatctgagggatgtgctgtaatttgatttacatgcattagagcacacagt

SEQ ID NO: 19031 - DNA, 531 bp, Homo sapiens
acttccgccgccgstccgccgcctccggaactaaacgcggtgaggtcacattcggttatctctaacgttggaaaacggtgggtagctttccagttgccgttaatttagaaaataagcaaaacgtgttgaaaaaataaaaccctgccagatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgcctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaatta

SEQ ID NO: 19032 - DNA, 505 bp, Homo sapiens
  misc_feature 455: n=a, g, c or t
acattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagtactctgggtcagacctctgaagacttctcagatggatcctagtctctgggcttgcctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattkgaagaatcaatacagcttagatggaggtctcctcatccagtggtaataaaacatcccacatagtgagcttagagagcacagcactgggatntaaagacatgggtcaattgcacctctgcatgtcagctgtcacttggcaat

SEQ ID NO: 19033 - DNA, 459 bp, Homo sapiens
acattcggttatctctaacgttggawaacgatggagctaacacccattatggagattaaccacttttcatcaggtttttaacttaagtcgtgaggaatacaacggtgaacacaagattcattttattttcatcaccatgggacgtatctgttgttgagtactctgggtcagacctctgaagacttctcagatggatcctagtctctgggcttgccctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtga

SEQ ID NO: 19034 - DNA, 460 bp, Homo sapiens
acattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagtactctgggtcagacctctgaagacttctcagatggatcctagtctctgggcttgccctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtga

SEQ ID NO: 19035 - DNA, 447 bp, Homo sapiens
caaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttgg

SEQ ID NO: 19036 - DNA, 368 bp, Homo sapiens
ttgctattactaaatgtcaagattgtatgctattatgtcttgtaaatttcttttgttggtgtaaatatggaaatgccacattggttaagtgccatcatttgtaatgcaatgtgtcacttgaaaagagattttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacatraaagaaaaataaatgtggaaatttcatccytgaaaaaaaaaaa

SEQ ID NO: 19037 - DNA, 516 bp, Homo sapiens
aaacaggtggccgttgtccgcgttgatggagaccagggaagagaggggcaggtgcgggtcctggggcggcagagcgaccacagaatagcgtcttgactcggacccagccagagaccctcccagaaaaacaaagagaagcaagacttgcctttgtctaagaaatcgctctcctcccgcctccattgcactttccgtcacgctcttccagggaatgtcgccaagctgaacctcagacagcgctgggaaacagtcttttgccccacaacctttgtagacggcctagtgaataagcctttccagaggctcagagttgctggctcaaaaatctgcctgggctctcaaccgctggtttaccacactggatccgtgcgtcaccgagcatgcacaatgcctgtggtttaattcgccttcttagtcaacagcgccaccatgcgttcgcttgcagttacaaaatcttggagaaggtgtttttattttgctttatcgattattcttatcaaccctagttgacgctac

SEQ ID NO: 19038 - DNA, 426 bp, Homo sapiens
agatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagcgagaagaatggtctggtgaagatcaaggtrgcggaagacgaggcggaggcggcagcgsggctaagttcacgggcctgtccaaggaggagctgctgaaggtggcaggcagccccggctgggtacgcacccgctgggcactgctgctgctcttctggctcggctggctcggcatgcttgctggtgccgtg

SEQ ID NO: 19039 - DNA, 580 bp, Homo sapiens
gtagtccagcgacctgagggcaaacaggtggccgttgtccgcgttgatggagaccagccacagaatagcgtcttgactcggacccagccagagaccctcccagaaaaacaaagagaagcaagacttgcctttgtctaagaaatcgctctcctcccgcctccattgcactttccgtcacgctcttccagggaatgtcgccaagctgaacctcagacagagctgggaaacagtctttagccccacaacctttgtagacggcctagtgaataagcctttccagaggctcagacttgctggctcaaaaatctgcctgggctctcaaccgctggtttccacactggatccgtgcgtcaccgagcatgcacaatgcctgtggtttaattcgccttcttagtcaacagcgccaccatgcgttcgsttgcagttacaaaatcttggagaaggtgtttttatttttatcgattattcttatcaaccctagttgacgctactggaggagtttctcatgttatatgaattaaataaatgcaatctagggaaataaaatgcacttttatctacgaaaaaaaaaaaaaaatgg

SEQ ID NO: 19040 - DNA, 309 bp, Homo sapiens
akcgcccacgcggaactcgaactcctgcagggcctcgtagtccagcgacctaagggcgaacaggtggccgttgtctgtgttgatggagaccagggaggcgaggggcagaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaatttaaaaaaaaa

SEQ ID NO: 19041 - DNA, 369 bp, Homo sapiens
gtagtccagcgacctgagggcgaacaggtggccgttgtctgtgttgatggagaccagggaggcgaggggcagaatcgcggtcttgaatgctgaaaagagctgcaacggtctcaggagaattttcgcggatggggcttgtgaatgaagccatggtcagttccggagcgttatcgttgatatctaccacctgtattatgacagtgcattttccagaaagacctgccccatcagaggctttaatatccacctgatatgacacaattttttcaaaatctagttttctgattattttaatttctccccttcgttcattaagtgcaaatgtcttagaaatctcttcatcaccataaaaaatgagtagaataaaaa

SEQ ID NO: 19042 - DNA, 424 bp, Homo sapiens
aagttgacgaggggtgggcttgtgatggttaatactgagtgtcaatttgactgggttcaaggatgcaaagtattgttcctgggtgtgtctgtgagggtgctgccaaaggagattaacatttgagtcagtggactgggagaggcagacccaccttcaatctgggtgggcagcatgtgatcatctgccagcgcaaccaagataaagcaggcagaagaaggtgacttgctgcgtcttccagtcttcatctttctcccatgctggatgcttcctgcccttaaacatcagactccaagtttttcagcttttggactcttaaagttacaccagtggtttgccaggggctctcaggcctttggcagagactgaaggctacactgtcagcttctctgcatttgaggttttgggacttggattggcttccttg

SEQ ID NO: 19043 - DNA, 449 bp, Homo sapiens
agatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagcgagaagaatggtctggtgaagatcaaggtggcggaagacgaggcggaggcggcasgcggctaagttcacgggcctgtccaaggaggagctgctgaaggtggcaggcagccccggctgggtacgcacccgctgggcactgctgctgctcttctggctcggctggctcggcatgcttgctggttgccgtgggtcataatcgtgcgagcgccgc

SEQ ID NO: 19044 - DNA, 62 bp, Homo sapiens
aaaaatctgtgctgtcaaactgattaggacctgactaccacctgcaggtcagggccaaggtt

SEQ ID NO: 19045 - DNA, 301 bp, Homo sapiens
ttttttttcgtaactggaagtagtaatctggcggttgacactctcgttgcctgtatagctgatggcccactcacctttttagctgggctcctgacctgtccggccagaaagttgccactgggaaacctggacccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaacgaagc

SEQ ID NO: 19046 - DNA, 462 bp, Homo sapiens
acggtcgcgcgtcccacagctcccttcacgtccgttcctccgtttccccaccttgggagggccaggacttccgaggctttagggggcaggaagctgcgagaaggtggcgcttgcttagaaacctggacccctactgaatggatctgctggcacctagacctcagagaagggggaactgaagactgaagtctgaccactgatctttgttgaaaatttctttctcaggggcttggagggatcacatctacaatcctgagctaatattctcttctgctgtccccaaaatttaaacgaagcttctcttaacccattgcaaatgagaaaaatctttgaatctacctatgactataagcccttatttcaagatatcctgcctttttaggccagaaccaaagtgtamctccatctattgatttacaattttgcctgtaactttggctttcctgaaatttaccccagcca

SEQ ID NO: 19047 - DNA, 326 bp, Homo sapiens
ttttttttcgtaactggaagtagtaatctggcggttgacactctcgttgcctgtataggctgatggcccactcacctttttagctgggctcctgacctgtccggccagaaagttgccactgggaaacctggaccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaaaaagcttctcttaacccattgcaaatgcgaa

SEQ ID NO: 19048 - DNA, 417 bp, Homo sapiens
taaaaatgagatttgtataaaagagtgtgcagtccctatggtgttaaaatcactgatatggaggagaagaggggttggaattgtgacactgtggcagcagatgaccttggacaagtcagtttttcagactttcctcccttaaaatagggatactaaatctcacagggtggttgtctataatgtcacccacacgccatctcctctataactgcatttgtatgccaggaaattgtctgtgaaggcttcagtttagaatagcttcatattattttggggcactgctgggtgattttggttaaggctggggcaggagaatggcgtgaacccgggaggcagagcttgcagtgagccgagattgcgccactgcactccagcctgggcgacagagcgagactccgtctcaaaaaaaaaaaaaaa

SEQ ID NO: 19049 - DNA, 537 bp, Homo sapiens
taatgacttatggaaattactacattccatttccagaaagagctattttccttatcatcttggttctaaaacagacagcaagcattgatgtcaccttaatgtagaaacagaagtttaatctttcaattagttagtgtctatcattcatccaaaaattaattactggcatttaacttgttccttattttacacccttagcaacattaataaatcaatacatcaattatcattttttcaaaatgttatcagattcccaaaatatagtaattacatcatcactaggtctcttttgtgactggataagaataaaacaaattttgtaataatatgagaaatgtgtttaccactatgggattttgaaaatataatcttgagatattattcttaagagtcaagagaagcctctattttcctttttcaaggatgaaaatcctccagctttataaaccatagactagaccaaaggctgctcaggtaaatttgacagcaccatatttaggttactagcacaacataaagtcaatacattcttgctgg

SEQ ID NO: 19050 - DNA, 518 bp, Homo sapiens
acaaactacgtaaagaataaaaattgcatccctcctttatttagatatgctctcgccattgttccatctatgatgagcaccctttctgcagaaagtaaaaatggccttactaagaaaattaaatttatattctagtgctatttctttctttctttctttttctttttttggagatggagtctcgctctgtcaaccagactgaagtgcaatggcatggtatcgcctcactgtaacctctgccttctgggttcaagcaattctcctgcctcagcctcctgagtagctgggactacaggcacacgccaccacgcttggctaacttttgtatttttagtagagatggggtttcaccatattggccaggatggtctcaatctcctgacatcgtgatccacccaccttggcctccgaaagtgctgggattgtaggcatgagccaccacacctggccttcaagtgctatttctttgcagtaccaggggacaagcattctctttctaaataaacattttacatata

SEQ ID NO: 19051 - DNA, 508 bp, Homo sapiens
tttagttttgaagtagctatagggagcaggtcttctgccttttagaattagaatcatagagtcaaaggacattaagctgggtgggctttagatcagaatccaccctccttatttttcatgtgggaggaaacagaggctaggaaaaattcagtgatttgcctttgggtgtgggagtgttctggctgagacctctctcatgtccctcccttacttaaatccttcagtactggccgggtgcagtggctcatgcctgtaatcccagcactttgggaggccaaggcgggaggatcacaaggtcaggagatcgagaccatcctggctaacacggtgaaacctgtctctactaaaaatacaaaaaattagccgggcgtggtggtgggcgcctgtagtcccagctactcgggaggctgaggcaggggaatggcatgaacctggagggcagagcttgcagtgagccgagatcgcgccactgcactccagcctgggcaacagaacgagactccgtctc

SEQ ID NO: 19052 - DNA, 497 bp, Homo sapiens
gaatgaatataaaatattgtaaaagaaaaattcataaagtttatgataaccatacaaatgcagtcagcaaaccagccacattcgtgattattttttaactgtgtggtggtaggaggtgctccttacagttttccctttgcaaacatttattccttggtttaacccaccactcttaaaattgccatcactcactgattcaccaaaaattgggtaaatatcttaccttgtttttattaatctttcttaagtgtatgtatagctcacatgtattttgatgttgaatattagaagtgactgggttttttggccaggtgccgtggctcacgcctgtagtcccagtgctttggggggccgaggcgggcggatcacttgagatcaggagtgtgagaccagcctggccacatggtgaaacccctctctactaaaaatgcaagaaaaagattagccaggtgtggtggcgggtgtctgtaatcccagctactccagaatctcttgag

SEQ ID NO: 19053 - DNA, 450 bp, Homo sapiens
aagaaggggatacaagttcttactctggtcatgaattttattcggaatgtcagctcgggtttggttggttgaaaagcatcattcagaaggaaccaacaaggagagagggggaattcctgcaaaaagtaataaactaaaagaaaacctaaagggtataaatgtaraattaagtccttttactctctccagttgaactacctagagaaaaccattttaaatcacaatttcagaagattttaaaaattcatctctacctaaagacatcataaaatggctcattattccatcatccaggctcccctgtttctcaggcctccagactgaagctgaattataccaccagctctcctcagtctccagtttgcagacaacagatcatgggacttctcagcctccataatcacaggagtcaattcctcataataaatctgtctgsccccttaaaaaaaa

SEQ ID NO: 19054 - DNA, 482 bp, Homo sapiens
attctaggtcacagcgcaggcgcactaatagacaccttaggcgcggastgagcaagtggcagtttagggagcgttaactgcgcatgaacaaattgctgcttgcctcaaggttaaggctccggtggtgtaataaaggatctgagaatttaattcctagctgaattggttcgaacgcgtttctgggacttttaccctctgttttgtcttctaacgctgggtaaaggccgagggttagcaacttttatgcatccctagtagtgagggatccttaaaaatgtttttttgaattaatgaacaatattactgtaattatcattcatggagctctaaattcttaaactcttcataaacacattttctcatttgattcttagaacagtcttgtgaagtgggtggtatataccgctctcttagggcagggactgaccttccaaagaggaagaaccaattccaacctagatttatgcgatgccaaatgaatg

SEQ ID NO: 19055 - DNA, 465 bp, Homo sapiens
tagaataaagaagtggagtgctcttgtaacagaaacctaaaatacactgtttcttggtattgttttgcagacagggcagcaggtagcatgggaaccataaaatgaatctgaaaaattacaacctatattgtgcagtagtaaaatatttggcaaagtactagcctgtagtaatttataaggaaaaaaaaatgaggctaggggctgtggctcacgcctgtaatcccagcactttgagaggccgaggtgggtggatcatgagctcaggagatcgagaccatcccggctaacatggtgaaaccctgtctctactaaaaatacaaaaaattggccgggcatggtggcgggcgcctgtagtcccagctattggggaggctgaggcaggagaattgcttgaacccaggaggcggasttgcagtgagccgagatggcgccactgcactccagcctgggcgacagagtgagact

SEQ ID NO: 19056 - DNA, 372 bp, Homo sapiens
tttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggagagtgccatctgggtcttccatctagaactgtttacatgaagataagatactcactgttcatgaatacacttgatgttcaagtattaagacctatgcaatattttttacttttctaataaacatgtttgttaaaacaa

SEQ ID NO: 19057 - DNA, 465 bp, Homo sapiens
tttatcagattgcctccttatgacgcggctcaaaaggaaaccaagtggtcaggagttgtttctgacccactgatctctactaccacaaggaraatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaasttctcgbtgccccagccatgttttcaaccatggcatccctcccccaattagttccstgtcatcctbaascttctctgtaagtgcctggtaagcttgcccttggcttaagaactcaaaacatagctgtgctctatttt

SEQ ID NO: 19058 - DNA, 478 bp, Homo sapiens
attttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcgtcggcggcggtggtgcctccggactgcacttgcgaagggagcttggggaggaatagtacaaaatgtcaaaaattagaaggaaggtcacagtggaaaaataccaagactatatctgatagcacatcccgaagacccagtgtatttgagaggcttggacccagcactggcagtacagcagagacacagtgccgtaactggctgaagactgg

SEQ ID NO: 19059 - DNA, 468 bp, Homo sapiens
  misc_feature 404: n=a, g, c or t
aaaagcggggaaagaagccggagagcggtggaccagacatctagacctgaaagctcgtgcggaggcagaggcgggatcttccggagtgagaattgtttttttattgtagcagaatggggaggaattgaggggaaaacggagatagaacctgaaagagccccaaacgtgagaatctgtaactccccaagaataagatcttccagaaaaattagaccgaaaactaggcgtctgggaaccctgacatccttggaggactagcatcatcatgaccctctgtgttccttttggcataaggacttgcttccattgtttgtttgttaaattgttgtgtttgtttaataaataaaaccttttcatgtatctttgaaattacgttggtttggccgagcgcggtggctcacgcntgtaatcccagcactctgggaggccgaggcgggcggatcacgaggtccaggagatcgagactat

SEQ ID NO: 19060 - DNA, 384 bp, Homo sapiens
tctttgtgccgccttcacccagtgaaggagcctgtatccaccctgcccagtcgctgttgggctgctgcggasttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaattaaaaaaaaa

SEQ ID NO: 19061 - DNA, 403 bp, Homo sapiens
  misc_feature 173: n=a, g, c or t
agtgttccgcccggggctccaccagggcagggatggtggtgagggtcgctcgtgggtcccctggcagggaacagggtctggcactcacaagggcgcacgactaggacttgtcgaatgaatcctttgtcgcctttagcttttagtcctttgaagagagcagaatggggaaatgnagagagaacctgaaagagccccaaactcgaggacctattgctccccaagaataacatcttccagaactagacagaaaactaggcgtctgggaacctgaaatccttggaggagtagatcatcatgaccctctgtgttccttttggcaaatgacttgcttccattgtttgtttgttcaattgtctgtttgttaaataaataaaacccttttcatgtatctttaaaaaaaaaa

SEQ ID NO: 19062 - DNA, 500 bp, Homo sapiens
aatttttgtttgtaatgtaaaatagggactatttgtaatatgagatagctctatttgttcccaaataaaatatattttacctttttctggtttgttctctgattgtttctttaacttgtctttcttaactatttttctttcttaactcttagtttacatgtagaagaaacttgtgattgaagactgtgcctatttattaacgcaaatatgacactaaaaattagcatcctgatactactgatttagtgtttacggtgaattattcatagaaatacttgctattttagcgattttttttttkgtttatgtagattagtttatgttttgayggaaattggagccccaatgatatctcggatacatgtcctatgcagtggtagcctacagagaaactcatcttctgcattatactaagttagaaaaatgtgatactgtgtggtccttttccaaaatgacactttattaatattattattctgagacagagtcttgctgtgtcg

SEQ ID NO: 19063 - DNA, 472 bp, Homo sapiens
tggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctc

SEQ ID NO: 19064 - DNA, 515 bp, Homo sapiens
cagattattcagggtagctgttgagattattcagggcagctgttgacatggcataatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggacctgggaacaggtgcaaaatatatgctgatacactgcctactggaattagcttaaastaataaactcccctttttctgtgaaaaaaaaaaaaaaatg

SEQ ID NO: 19065 - DNA, 396 bp, Homo sapiens
  misc_feature 154: n=a, g, c or t
aaggtaaaayktcmcactgcgaggcaggcagtgatgctgcggccgcttcgcactgtggctcctgccgaccgccagcgctgttacagtggatgcgaactaaccgtaagtatgcagcagcagccggaacccacagttcaccttggtgcattccttnatgatgaagacttattgattcattatatgagaaaggaaaaatgagcagaaactactgtatgatgtgcagctcacaccagacagcaactttagggttatctttccagttcagcagtgcaactctatggagtagaattgaaaggagacttttcaccaattgcaggaaatggtcataaaaaaatacctgctcactgacagaataaaggtaccttttaacttaaaaaaaaaaaaaaaaaaaaaaaa

SEQ ID NO: 19066 - DNA, 413 bp, Homo sapiens
actgcgaggcaggcagtgatgctgcggccgcttcgcactgtggctcctgccgaccgccaggcgctgttacagtggatgcgaactaaccatgcagcagcagccggaacccacagttcaccttggtgcattcctttatgatgaagacttattgattcattatatgagaaaggaaaaatgagcagaaactactgtatgatgtgcagctcacaccagacagcaactttaggtaggcacttagagtaatttatccctacttacagagagattgccctacgtgtaacagctgcatacaaaaaagttataaaattatcattggtttaacaaggataagtgaaaaacattaaaattctccaactgaacaaggtgtgtctgtttcattgattggctgactgtcaaatcggaatctgatctgc

SEQ ID NO: 19067 - DNA, 381 bp, Homo sapiens
aaggtaaaatttcccactgcgaggcaggcagtgatgctgcggccgcttcgcactgtggctcctgcgaccgccagcgctgttacagtggatgcgaactaaccgtaagtatgcagcagcagccggaacccacagttcaccttggtgcattcctttatgatgaagacttattgattcattatatgagaaaggaaaaatgagcagaaactactgtatgatgtgcagctcacaccagacagcaactttagggttatctttccagttcagcagtgcaactctatggagtagaattgaaaggagacttttcaccaattgcaggaaatggtcataaaaaaatacctgctcactgacagaataaaggtaccttttaacttaaaaaaaaaa

SEQ ID NO: 19068 - DNA, 580 bp, Homo sapiens
  misc_feature 569: n=a, g, c or t
mtyyytyycrtsmgysyycssgcgkccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccasgtgatcctccgtgacattgcgagagccagagagaacatccagaaatccctggctggaagctcaggccccggggctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggcacggccccacagacccagcacgtatctcccatgcgccaagtggagcccccagccaagaagccagcacaccagcagaggatgacgaggatgatgacatngacctgtttgg

SEQ ID NO: 19069 - DNA, 526 bp, Homo sapiens
ctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccasgtgatcctccgtgacattgcgagascagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggargcccggctgaacgtgctggagaagagctcgcctggccaccgggcacggccccacagacccagcacgtatctccatgcgccaagtggagcccccagccaagaagcagcacacagcagagatgacgag

SEQ ID NO: 19070 - DNA, 501 bp, Homo sapiens
cagattattcagggtagctgttgagattattcagggcagctgttgacatggcataatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggactgggaacaggtgcaaaatatatgctgatacactgcctactggaattagcttaaagtaataaactcccccttttttctgtgaa

SEQ ID NO: 19071 - DNA, 436 bp, Homo sapiens
ctccctgttcatcaktcttcccgcgtccgccgmttcctcctccytggtcgccgcgtccttggctggcgtcagaaaaatggctacaaacttcctagcacatgagaagatctggttcgacaagttcaaatmtgacgacgcagaaaggagattctacgagcagatgaacgggcctgtggmakgtgcctcccgccagsmgaacggcgccasgcwgatcctccgtgacattgcgagascagagagaacatccagaaatccctggctggaastcaggccccggggctmyagcggcaccakcggagaycacggtgagctcgtcgtccggattgccagtctggaastggagaaccagagtctgcgtggcgtggtacaggakctgcagcaggccatctccaagctggaggcccggctgaacgtgctggagaagagctcgcctggs

SEQ ID NO: 19072 - DNA, 412 bp, Homo sapiens
  misc_feature 87,95..98,125,239: n=a, g, c or t
attcccgtgcgcggcccgggcggccctccctttcatcagtcttcccgcgtccgccgattcctcctccttggtcgccgcgtcctkgknkggcgttnnnnggggtttcaacgtgttggccaggatgntctcagtctccagaccctgtggtccgcccgcctcggsctcccaaagtgttgggattacaggtgtgagccaccgtgcctggccgaggctccttcttttatgaggavcgggaammnmtcctgcaccctggagaccgtgtgggaagacaagcrcaagtatgaggaggccgagcggcgcttctacgaacacgaggccacacaggcggccgctccgcccakcagctgccagccgaggggccagccatgaatgggcccggccaggacgaccctgaggacgctgatgaggcgga

SEQ ID NO: 19073 - DNA, 426 bp, Homo sapiens
  misc_feature 314,349,363: n=a, g, c or t
acacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagatgcagttcgtcaacttcacatggaattcttgagagcaggatcaaatgtcatgcagacttttaccttttctgccagtgaggacaatatggaaagcaagtgggaagatgtaaatgctgctgcctgtgacctcgccanggaagtggctggcaaaggtgatgctttggtagcangggggatctsccanacatcaatatacaaataccasaaggatgaagctagaattaaaaaactttttcgacaacagcta

SEQ ID NO: 19074 - DNA, 615 bp, Homo sapiens
gatccgcccgcctcggcctcccaaagtgctggaattacaggcttgagccaccgcgcacggctttgcagcaagcgttttgaattttgtggcccggaattcactgcgargactgggatcacccatcacccttccctggtctccgaaaaatgaaacgtgtttactgatacagaaacggaataacggcrctktgggctggggwgggcsgagtgcctcaggcttctggtctccagckgcgsggmactcacacctgccgctgtgaaaatgcagacccgcggggcagkaattccgagtccagsctggrgcgcgatctggaatctgactcgctkgaaacagcaccrcgkggattcggakmyrrgtgagtagrgaamtgmgcctcagcccctcccrcrgccgcccamrgattccaggrtccgraaackcttcctgctgctgcgtcaccccaggaaggcagcgccgcctctgggccgttctgatggaaactggcttcgcgcccagaggaaaacccacaactaaggggccaagaaaaagcctccatggtcccgccctttcagtgaggatcctaatttataccccgagtgtggcccccatcaaagtctgcagtgacagccgagcgcg

SEQ ID NO: 19075 - DNA, 433 bp, Homo sapiens
  misc_feature 239: n=a, g, c or t
gatccgcccgcctcggcctcccaaagtgctggaattacaggcttgagccaccgcgcacggctttgcagcaagcgttttgaattttgtggcccggaattcactgcgargactgggatcacccatcacccttccctggtctccgaaaaatgaaacgtgtttactgatacagaaacggaataamggcactttgggctggggagggccgagctgcctcaggcttctggtctccagctgcgcgncactcacacctgccgctgtgaaaatgcagacccgcggggcaggaattccgagtccaggctggagcgcgatctggaatctgactcgctggaaacagcaccgcgtggattcggatctgagtgagtagggaactgcgcctcagcccctcccgmagccgcccacagattccagggtccgaaaacgcttcacccctgga

SEQ ID NO: 19076 - DNA, 465 bp, Homo sapiens
gatccgcccgcctcggcctcccaaagtgctggaattacaggcttgagccaccgcgcacggctttgccagcaagcgttttgaattttgtggcccggaattcactgcgaggactgggatcacccatcacccttccctggtctccgaaaaatgaaacgtgtttactgatacagaaacggaataacggcactttgggctggggagggccgagctgcctcaggcttctggtctccagctgcgcgcactcacacctgccgctgtgaaaatgcagacccgcggggcaggaattccgagtccaggctggagcgcgatctggaatctgactcgctggaaacagcaccgcggtggattcggatctgagtgagtagggaactgcgcctcagcccctcccgcagccgcccacagattccagggtccgaaaacgcttcacccctggaaggcagcgccgcctctgggcggttctgatgg

SEQ ID NO: 19077 - DNA, 518 bp, Homo sapiens
  misc_feature 517: n=a, g, c or t
cagattattcagggtagctgttgagattattcagggcagctgttgacatggckkkatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggacctgggaacagtgcaaaatatatgctgatacactgcctactggaattagcttaaagtaataaactccctttttctgtgaaaaaaaaaaaawtycgaamnt

SEQ ID NO: 19078 - DNA, 423 bp, Homo sapiens
aaaacaaataagtttacgtagattggaagtccatattttatttctctagtgacatatttacagttcaatataaattaaaggcctgcttgtacaccaaatccagtcccttgggtggttcagtcaaagaggatggccatagcagccacaaaaggaagcaaacaagaacaagtcctgatggagcaatttatgaagacaggcagcatagagggagaagaacctgtctgtcaaccccacacacgctttcccagacgtctcctgaaagctgagcatttggtatcttaaagcctcttaccagtttggatagatatggatcttccaaaattaatgagctccttaatatcgacactgtttatcaacataaaggatcaatttaggaagattataaaaactgaagtttccggaacaataaatgggagaattaat

SEQ ID NO: 19079 - DNA, 387 bp, Homo sapiens
  misc_feature 70: n=a, g, c or t
ctctgggattcgtgcaagtagcgtgcgtgcccttgtgagtttggagggtgccggtcagcggascgtggantgtatttgaaaagyaatcagtccgaccttcccccatagattcatcctgcctgaaaatcatatgcgtggtttttcctgtttcctgctctgtagctgacatcaggggagmaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaaacaatgctcctgaaggccccttttccctcaaaagaattcac

SEQ ID NO: 19080 - DNA, 586 bp, Homo sapiens
aaaacccggagcgtcggtccccggagtccccgccggcagcgcctcagctgaagaccttggtagaaaaatgctgacttcccctaagcaagaaggaattctggcagcaaacagccattgacttgcagccttttccctagacctgcagcccgcctacctactctgaagattttggagttgccaagcctccacaaccatataagccaatacctttctctctctttctctcttttctctctcttaaactgcaaaaagcaaacaaacaaacaaacaaacagacagcaggttcaaaatggagtcactcatactagtgtcacataaccaaaccaaaacttgcgttatttacttgcaagatttgaccttgtgagaaatcagaagagagataacagtggaatccaactaggccaacaagattttgcttacatctgtagaagaaaagtaaccttgaaatgaccaaccctctatttgttctttatttctgcttttctcttcttttttctgcccataaaactcacccactctgtttagctcatcagagtttctttctactttgtagactggatgctgcccagttcatgaatcactaata

SEQ ID NO: 19081 - DNA, 507 bp, Homo sapiens
aggatttctcaacacatgcttgagtcagggtcataacaataatggcttaagtttactgagctcttttttactatatgccaggcagtattctcaatattttgcatgtattaagtgatttcattttctcaacacccctatgaagcaaatacttctgtgagccccatgttacaaatggagaaaccaaggctcatggagattaagtaagctggtcaactttatgtagataataagtagtgaactctgaatcctgaggccatgtcctcaactatcagactttgctgtttcacgtataattgtctttgaatctgtatctccagaaccctctcttgtcctagcaggagtgtaaaaatgcttacgaatcccatatcaccctcgcattattcagttttgcaccagacgttgtgacctcagccaggaatataacctgtctggagaccaatacacagtgctgcattttctccaaatgattcaagatcttcctagcactcaatgggcctgagaacgtat

SEQ ID NO: 19082 - DNA, 468 bp, Homo sapiens
aggatttctcaamacatgcttgagkcarggtcataamaataatggcstwaagttactgagctcttttttactatatgccaggcagtattctcaatattttgcatgtattaagtgatttcattttctcaacacccctatgaagcaaatacttctgtgagccccatgttacaaatggagaaaccaaggctcatggagattaagtaagctggtcaactttatgtagataataagtagtgaactctgaatcctgaggccatgtcctcaactatcagactttgctgtttcacgtataattgtctttgaatctgtatctccagaaccctctcttgtcctagcaggagtgtaaaaatgcttacgaatcccatatcaccctcgcattattcagttttgcaccagacgttgtgacctcagccaggaatatacctgtctggagaccaatacacagtgctgcattttctcmaatgatca

SEQ ID NO: 19083 - DNA, 481 bp, Homo sapiens
aaagcctgcgaagtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggrgaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaacaggtgagaaggagagtgctgctaagctcccgcct

SEQ ID NO: 19084 - DNA, 429 bp, Homo sapiens
gagaatttccagcaggcaaggcagtggccgctttgactgcttgcttcggagatccgagacgacggagaaggcactcttatttaccgaccaagaaagctcctccgccgttctccgttagctaattaaaacatttttcagggacgtagccatccagagggatttgcttcctaaggagaagaacttggaaactctgttgaccttggcttttctagaaatagataaagcmhbatcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaa

SEQ ID NO: 19085 - DNA, 474 bp, Homo sapiens
  misc_feature 389: n=a, g, c or t
aggacacatgacttagttatggtacatacgtgtgcacgttcagattttgaaaacaaatatagccaaaatcagacatatgtgcagacccagataaagttagtcaaagctaatactgtgattcatccataaaaccacttagtggtgattcagagttgcagacaccaaccccaagggccagacattcaaatacagcttcataggttagattcctggctactcccagacacagagttgggcatttatggggaaagacaaattctggagacacaggcagctgggacaggaaagatttatctgtctctagatcaccccccaagtcagacaytkggtgttgaaggttactcatcagtttcccctatggggacatggctcacaatgtgtgggcaggntagtggacagcagggccttgsacacccaccacatmmmcatgtgcatgcacatacacacacacacaacacacacacacgcacacaa

SEQ ID NO: 19086 - DNA, 192 bp, Homo sapiens
taagaatataattgagttacatagaaaaatgtgttatttggttgtatccagagtacggttgcctgtatttatttggcagccctaatccagagagatggtgcaaactagacacttaaaggtgggcttcccctctgggctgtcatacactctgttgtccaaacacatttgtctttttwtttttttttttttttt

SEQ ID NO: 19087 - DNA, 516 bp, Homo sapiens
actctcttttgaatggaatcgggctgattcatcgcyggtttgcagacaragccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggcacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatg

SEQ ID NO: 19088 - DNA, 471 bp, Homo sapiens
atgaagttgcatgcaggcaaagagagaaaaggaactagggggctggagtctttaagaggtgaggcaaggtaagcaggtttaggactggctagtttgagtaattgtagagggctctggggggacaaggggttgtccctagttgtctgatacctggtcctggggtgattagggcaggtggatattggcccaaaaatgaaagcttgataaagagggtggttgggggtgtgggctctggattggtgggtttgcataggaaaggtgtcgcctctctctagatattaactaaccctggggggggcggctatccctccaggatcagcaataccccagatatcaaagcaaataatacaggaaataaaaagacatggtgaatacaattggcttgactaggcagggtggcttacaactgtaagcccagcactttgggaggctgaggcaggaggatggctggagcctaggatttgagattag

SEQ ID NO: 19089 - DNA, 550 bp, Homo sapiens
tgccgggctgaaaaattttctaagtaatgtctaattccactttcctagtagttacagttcagtgagtgtaattaccgtctgagggttgaaaactggtggcccatgggctttatctatcagcaaagatactttgtttgactcacaatattaaaagcagttcattgattagtgttattagggcactgcctctccagttgatgtcagtccctatcatgcctagtatcttacacctggcctgcttcattctcttgtattaatattacttgcctggcaataggtaataatcctattacatgtcttgcaaaatgtaatcatcagtttacatgttcacgtgagtrrkatttcaacccctgaatgaaactgttctttaatgatttagcttctttgggtgtgtcaggatcatctttgtgagcatttttctctgtgcagtgctatagaggtaaagatatacatcaggaatgtattcttgccattcagagattcataaaattttaatagaagataatttagagattgagtgcagaagctgagaccaagattgggtaaataa

SEQ ID NO: 19090 - DNA, 469 bp, Homo sapiens
atactagatttggaaataatcaaactaggctttgttctgccacaactaggtaaaaatgttacttctttctgactttttgtaaaatcaggatggaaatatatttcatatcattgttatagctaatagctattaagcacttgtatgtttcatactgtgttaagggcttttatatatttctcattgtattccgacagaaccctacaaagtagagacagttccaaatttccagaatgaatgtgagattgtgatacatatgacaaactgcttattaaactgtacagcacctaacaacatgagggattatgcctaattccctacacagtgcatggcatacacaaggactcatgagatgctgttgaagaataaaagcagctctactttacagccataggaagcacatacatattcagccatttgaaaacagtgtgtcttgatgaaagaggattgcagttggattaatatgaacagt

SEQ ID NO: 19091 - DNA, 415 bp, Homo sapiens
accatttccaggctcaaatcactgtggaggaacaagcaacaaagtcttgtcaggaccttatctcagggtaacgattagttaaaaatgaaaggctaaaatattgattttctttagaagaataattgactgtttgatatagagaacacccagtttcttcctgaggaaagctgaacagggctacattagcagcccgcgtctctctgacagcagcaggggctgggtttaagcagcggctgctttgcctggggagcacccgtaaatggactttggtctcaatgctttgactctttgccgtggttttggatgttggaataccggcggtgatctgtcttttataaactcacctgatttaaaggaaagatgagtgaagaaccaaaggagaaaaatgcaaaacctgctcataggaaaaaaaaaa

SEQ ID NO: 19092 - DNA, 839 bp, Homo sapiens
accatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggatttgaatttwaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagttgctcacgcctgtaatcccaacactttgggaggccgaggcgggc

SEQ ID NO: 19093 - DNA, 463 bp, Homo sapiens
agtgggacccgaccctgtctccagtgggcgtcttgggccccggctctattctgggctgcgggcctgggaagggctcggccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaaaaa

SEQ ID NO: 19094 - DNA, 516 bp, Homo sapiens
caagaaaagatggtgtacatctatcattccttaaagaatagtagagagacacacatgatgggaaatgaggaggaaacagaggtttgtttcaactgaaaacaaatgcctatcctgtgacttgggtggtggttgggaagaattgattatttttgattacaggtaatatgctttttatggctgcactgtggacttaaccattttgcactactcacagagctcctgcatggggatgattaagtcagacatttctgtgatacatgcacaccagttttaagacatactagctgggacctgtagccttataggaatggtataatgtaaaacatttcaaattactaatatcacttactacataaattaggatgccttttatatagaagttggcatcttttatgttatctaattgtagtgtgtctaaaatactcatgaggggtatcaaaaataatgatgtatggagaataaatttacaggaaaatgctacttcaatgacataagtagtatacatatattttgaca

SEQ ID NO: 19095 - DNA, 484 bp, Homo sapiens
  misc_feature 18..19: n=a, g, c or t
cacacacacatgcacgcnncacacacacacacacagaaggtgaacacacaggatgaggccctgaaaactcatttcacccgtgtacctcacccaaaaattcccctttgtactcctatctttatctctaactgacagcatgaaggtagcccgaagtcccctcaccctgtctgtcctcctgattctctagcccagttccctctagctccagcacagactcttatctccagccctgactgccgaaaccctccagccccagctccagcccctcaggaggggactgcgtgggaggaatgactccagcaagccggcagctgacccgtctcctgcctgcacgcctcccgctgtggtccactgccggtggtcttcagctctctcctcgtcccacccccatggtctgctgacagcccagctcagtgcatccctgccatctctgctctaccgctggtcctcccaacaaccaacttacagggtttcactcccgtca

SEQ ID NO: 19096 - DNA, 356 bp, Homo sapiens
atctctgctctaccgctggtcctcccaacaaccaacttacagcttccaattgtggacaagataaggaccattgcccaggctgtctatggagccaaagatatcgaactctgtcctgaggcacaagtcaaaatagatcgttacactcagcagggttttggaaattttgcccatctggcccatggcaaagactgatctttcychcggyytcaccaacctgacaaaaaaggtgtgccaagggacttcatcttacctatcagtgatgtccgggccagcataggtgctgggttcatttaccctttggtcggaacggtgcaccactgacatcatggctcggctggactctggaaagcaggaaa

SEQ ID NO: 19097 - DNA, 203 bp, Homo sapiens
atctctgctctaccgctggtcctcccaacaaccaacttacagcttccaattgtggacaagataaggaccattgcccakgctgtctatkgagccaaagatatsgaactctgtcctgaggcacaagtcaaaatagatcgttacactcagcagggttttkgaaatttgcccatctgcatggcmaacactgatctttctctgtctca

SEQ ID NO: 19098 - DNA, 348 bp, Homo sapiens
  misc_feature 340,342..344: n=a, g, c or t
atctctgctctaccgctggtcctcccaacaaccaacttacagcttccaattgtggacaagataaggaccattgcccaggctgtctatggagccaaagatatcgaactctgtcctgaggcacaagtcaaaatagatcgtacactcagcagggttttggaaatttgcccatctgcatggcaaagactgatctttctctgtctcaccaacctgacaaaaaaggtgtgccaagggacttcatcttacctatcagtgatgtccgggccagcataggtgctgggttcatttaccctttggtcggaacggtgcaccactgacatcatggctcggctggactchgacnannnagga

SEQ ID NO: 19099 - DNA, 351 bp, Homo sapiens
atytyttsyyywaccggytggtcctcccaacaaccaacttacagcttccaattgtggacaagataaggaccattgcccaggctgtctatggagccaaagatatcgaactctgtcctgaggcacaagtcaaaatagatcgttacactcagcagggttttggaaawtttgcccatctgcatggcaaagactgatctttctctgtctcaccaacctgacaaaaaaggtgtgccaagggacttcatcttacctatcagtgatgtccgggccagcataggtgctgggttcatttaccctttggtcggaacggtgcaccactgacatcatggctcggctggactctggaaagcagga

SEQ ID NO: 19100 - DNA, 184 bp, Homo sapiens
atctctgctctaccgctggtcctcccaacaaccaacttacagcttccaattgtggacaagataaggaccattgcccaggctgtctatggagccaaagatatcgaactctgtcctgaggcacaagtcaaatagatcgttacactcagcagggttttggraatttgcccatctgcatggcaaagam

SEQ ID NO: 19101 - DNA, 528 bp, Homo sapiens
cccatatcctaactgaccagtctaaagcatggctcattgtggccaggttaatttttcctgatgcaacacagcacaaaaatgttcgtggcccacaaatcaagtcctaggcttgctcaccaatgccttcaatatttgcccaatataccttttcaactttaatttcccacttcctcgggcacaaaatcttccatctcagtcatttcaggtgaagtccacagcctgagacatcataaccgccgaattcctttattcatgtggaaaagccatcccttggcttttacattcttttctccctgcccatctgaatgctgtcaccttccaagccccagcccatttctccagcccatattaattatgctttttctgaaggtctaaagcacttaactgacagtactatttatcttgtcacttagttaaattcagtaagtgctactactgctcattttttgttttgggagatttttttcaaggagcatttctacattcctggcattgtgtttggtsctcaaaatgttttctcacttaatt

SEQ ID NO: 19102 - DNA, 444 bp, Homo sapiens
aaaagttatccacaatgttttgaagccctaagggtagaaagggactctaaaggccaggccaaatacttctaaaaatgaaagtaaccacttgcaaatcagtaagccttgcttttgaaagaaagatacactgtgtttccttgggggcagataaggaagagtcataacctaagtgttgtcagttcaatattccataaacactaatgagaaccaaggtctgtaaagagagaacggattatttgaaatttaatagatgaacaaaggaaggatcattgtctatagaccatgaggtcttggragacagraaacccaytggtttkgawactttgtagctctgtcagcacatggaaagaaactggttttcctgtaaaactaatacatgtgattattaaaggtaaaaacataacaaatcaaataaaaaaggattaatcatttaaaaaaaaaaaa

SEQ ID NO: 19103 - DNA, 439 bp, Homo sapiens
actttacctggtgggtgaaaatttgatgagaaatttacataactccaaagtacctgatcagaagatatttattgattaaaaatggaaaatcagtaactttacagtgcagaaacctgacagacaccacctcattcaagtgatcaaaattagcatagtcagactgtaatcccagcggtttgggagtcgaggtgggaggatggcttgaggccaggagttggagaccagcctgggcagcatagtgagaccttgtctctacaagactatttttaaaaaattagctggaggggatggtgctatagttccagctagttggggtgagagatggaaagattgcttgagcccaggagttcaagtctgcagtgagctatcatgagctatcatgacactgcactccagcctgcacagcacaagaccctgactctcaaaaaaaaaaaaaaaa

SEQ ID NO: 19104 - DNA, 556 bp, Homo sapiens
  misc_feature 534: n=a, g, c or t
aacaaatcaatcattcctaaatgtaggacccaaacttatatcacagaattgtgtgtgtgtgttgtttggtgagaatgatgagagctgagcattgtgaaaatacaggcgggggtggggtaacagagctgggtaggggtccagggcgcttagattgccttattgtccaggcttagatgcctcttacccagagccatcaggtgtaccctatatagctccagcctttctgcctactcctgagaagataaactgggatcctgcagtctggattcctagaaggagatggaaagcccagccatatccccagtttgacttgaccagtagtaaaactagcactacagtttgatccctttttacctccttgaatatcttcaattcatcaaggatctgtaaagaaggagaggtacaagatatatgaaacccaaatctcaaaacaatgatttagtgaatttcccatgaactttaaacagtgattgcttcaaaatttccaagagccatactctccctccagctgctgtgtgtgtgtgtgtgtataantgcacactattttaacctaaat

SEQ ID NO: 19105 - DNA, 422 bp, Homo sapiens
cctgtaaaatatcccacattttgaatttgtctaattgttttcttacagttagagtcaggataaacatatttggcaagaatactgagtaggtgatgttgtgtcctttccacggcatcacatcagaaacaggtcatgtcagtttgtctcaatattgatggtactgagcttgatcccttgattaaggtagtgtctgccagatttctccagtgtaaagatatcctttccttttgtaattgttaagtaaatttgggatgaaactttgagattgtgtgaatatctctttcctcaaaagagcctaattttgagcctgtttaaaccaaccgaaaaattccggaatcacctgcttttagaaaatcagttgagatcacatgaagactgcatttttaagtcacagcagagttcaaaagaaaaaaaaaaaaggc

SEQ ID NO: 19106 - DNA, 503 bp, Homo sapiens
tacaaaaatggaatcataggcacactttcctccaccttttctcattcagtgctaactcttggaagttcctccaagtcaattagaatagttctattattatcttgaatggcttcataatattccgtggtgtgagtgtaccacactttattccaccattctttagctgatggccatttgctttgtctgcaataatttttgccactataaaccattctgcaataaacctccttaggtaaataggtagctggatatgtaggtatttttctctctttctcatgtactggtagttatattctgaaatacgtttttaggagtgagattgattaaccaaagaatatattaataatttccagttcttatactattagtgatttcgagcatcttttgatcgtaggctttatgatatcttttgctcttcccagaagttttaaatttttaaatgcattatgtgtccatgtttaatacttctgagttccggccaggcatggtggctcatgctgtaa

SEQ ID NO: 19107 - DNA, 168 bp, Homo sapiens
aaaaattctaacatgccgtaagattctataattactactctaagtgatcatttgtggacacgggccaaactcgaataccatttttatcaaagaagagaagtaaatgaaaagttcagaaatgttttaagatggcgaagtgacagtaacatttaaaaaaaaaaaaaaaaa

SEQ ID NO: 19108 - DNA, 548 bp, Homo sapiens
taacgagccaaacaaaaattctactaggccagtataatagggcctgcagagcctgtcatgggttcagggttttcccataaagataggtgtacctcagatactactcctaggtcctggctttaacctcaaagcccctctgcctgtcctgctctgaaacctctggggcagtaggcattgacttctgggctagggagtaaatgttccgtgtccttatgtgagcttcctattacccattagcattgttttatgaagttttcaattttatatccagcctgggagacagagctagactccatctcaaagaaaaaagaagaagaagaaagctaactcagtacactaagagtgatttacatgcctgcaaataatttgtgtctggggtcttgaccctccccaaatgccttgttatttatatctctgcttttagataacagatggtcatgtgtctatgggcttgtaccggcagaggcaacagcaggtccttaagactccccaggtgccatgatgaaaagaaccttagaaaatattgaaataatctcaaaaaaaaaaaa

SEQ ID NO: 19109 - DNA, 515 bp, Homo sapiens
tcgaagtaattacacttgacctgctacctaaaacgatgtaatattacaacttttttgaataatctcaggaaaaatggagaaatgtttatattcatagttaataaacattctagatagtaaccaactgtcatttactgaaaataaaattttacccaggtttattttatttttgagacggagtttagcttttgttgcccaggctggagtgcagtggtgtgatcttggctcagcgcaacctccacctcccaggttcaagcaattctcctgcctcagcctccaaagtagttgggattacaggcatattccaccatgcctggctaattttgtatttttagtagagacagggtttcttcatgttggtcaggctggtctcgaactcccgacctcaggtgatccgcctgcctcggcctcacgcctgtaatctcagcactttgggaggttgaggcagaaggatcaccagagcccaggaatttgagaccagcctgggcaacatagtgaggaccacgtctctacaa

SEQ ID NO: 19110 - DNA, 473 bp, Homo sapiens
tacgaataatggtgtgaagattaaataagacaatgcatgctcagtgctaagttctttgtcctgacatattaatagctcaatgatttccagttattactatttccaaatgtcagacatatcatactgaaatgactttttctgaataaccacaaacaacacccaaggaatagcaaatatatttctttttgttgctaatcctcattcctttaaggcttacatatgattattaaaaattatatcacaaaattgtacattctaaggaaattttggtgttatttagtcttatctgtcgagagccagagacttttcagaacatgccagagttgcctttgaagatgtccctgctcatatttatcaaaatggtaaatatggtaaatacatctttcgttgcaaagccaagagggattgcctcttttgagatgcttttgaagaaaaagtaagaacgtcaggttgcgcacctttaagttcaaatg

SEQ ID NO: 19111 - DNA, 452 bp, Homo sapiens
atcccaggacgatgtcttgcatttggaacctacaaaattttgatttgtcgtttaatatttattgaattagttgattcgctgggtgcaacgaccargaaaacaaatgtgaggacattcctaaactatttccaagtggctctgaattttttattaatttagttctctaacattttgttgtcaggcggtgtgctaggtactaaagaaacgaaaatgcaatccttgctttcagcaagctcactacggtctaacggagacgacttttaacataaatagtaattgtaaaacgatgtgatgagtccaatgatggaataatgaaggaggacggcagagggccacttaactggccaggaaggcttggacatggtgacgcccaccatagatcatgccggataaggaggagcagacctagcgaacaggaggcaaagaccattggaagacaatggggaagagag

SEQ ID NO: 19112 - DNA, 480 bp, Homo sapiens
atcttctaacccttggaggaaaatctgcgctccagcagctgggaccgaggcatgagagcgttgaatcatgagtggcaccgttcgcaaaaattggtgtctttgtacaaagacagtgccacaacacaactcagtgaccatcgggagagcagcctcatgatgggcgatgctccatcagttttctcttgcgatcttttgcatagatcggtcccgccccgcatatggcgatgaggactcaagagacacggaaaacgttttctttctggaaaacatgaaataggctttgtagatggacaggaagtcaagggacaagcggtgcgccgcagagagcgaggacccactcttctattcctttgcggaggcacggacacacggtgtggcccgaaacagcggcaggagagtgagacccgggctccgaccgcggtgacggagtctcactctgtcacccaggctggagtgcagtggcacgatctcggctcactg

SEQ ID NO: 19113 - DNA, 394 bp, Homo sapiens
tagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagatgttgttaccatcttctttgtttgtggtacaatattttcagtgcaaaagagatgtattcagttaaaaagacaaacctytagatgtgtaattacatggaaaatactagcaatgtgaatgcttttgtagtaaccatcttgtagtacctgtgaaatctataactcagaaat

SEQ ID NO: 19114 - DNA, 354 bp, Homo sapiens
agcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgccgagtgctacatccgcggcacaccatcaagtacctgcgcatccccgacgagatcatcgacatggtcaaggaggaggtggtggccaagggcgcggccgcgraggcctgcagcagcagaagcagcagaaag

SEQ ID NO: 19115 - DNA, 612 bp, Homo sapiens
tccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactggaaacaaacacatttaaaattggtttacctcaggatgacgtgcagaaaaatgggtgaagcataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttcccaataaaaa

SEQ ID NO: 19116 - DNA, 484 bp, Homo sapiens
  misc_feature 60: n=a, g, c or t
ctattcaaatgggttctagttcaatttgtttagtataaattgtcatagctggtttactgnmacaaacacatttaaaattggtttacctcaggatgacgtgcagaaaaatgggtgaagcataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacacccatcaacattgctgttcaaagaaattacagtttacgtccattccagttgtaatgctagtcttttttttttttttttcccaa

SEQ ID NO: 19117 - DNA, 493 bp, Homo sapiens
accatgggaacgaaccgccgcgcctcgcccaggacagttacacttagaggccttggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggaacttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccaataaaggctggtgctgacctctaaaaaaaaaaaaaaat

SEQ ID NO: 19118 - DNA, 387 bp, Homo sapiens
  misc_feature 342: n=a, g, c or t
aaccgaaccgccgcgcctcgcccaggacagttacacttagaggccttggaggaaaagagattgccctagggttattcggaaacaatcctgtttgaaaaggtgcatcactgatgagacatgtccaggtgtaaagaaatgctgcacgcttggctgcaacaagagctgtgtagtcccaatctctaaacagaagctgggaagaggacacccaccctggtacctggtccctggcgagagtcttgtgaaaatgaagaacaattgcttatgctgttttcctaatgaggaacacaaggctcactggtacagagttggaaggaatggaggcaagcagagaaaggcccaggntttgtggagcttgatgcttgtataattatggataccttgttttag

SEQ ID NO: 19119 - DNA, 449 bp, Homo sapiens
atgggaacgaaccgccgcgcctcgcccaggacagttacacttagaggccttcaaaagagggagaatgccctcccgataagaacccatgcaaagagctgtgccagggcgatgaattgtgtccggctgaacagaagtgctgcaccacaagctgtggtcggatctgccgagacattcctaaggacggatttcgctcttgttgctcagactagaatgcagtggcgtgatctcggctcaccgcaacctctgcctcccgggttcaagtgattctcctgcctcagcctcccaagtagctgggatttacagggaggaaaagagattgccctagggttattcggaaacaatcctgtttgaaaaggtgcatcactgatgagacatgtccaggtgtaaagawatgctgcacgcttggctgcaacaagagctgtgtagtcccaatctctaaacagaagctg

SEQ ID NO: 19120 - DNA, 456 bp, Homo sapiens
  misc_feature 410: n=a, g, c or t
catgttcaagaactgtaatgctgggtgggaacatgtaactttagactggagaagataggcatttgagtggctgagagggcttttgggtgggaatgcaaaaattctctgctaagactttttcaggtgaacataacagacttggccaagctagcatcttagcggaactgatctccaatgctcttcagtagggtcatgaaggtttttcttttcctgagaaaacaacacgtattgttttctcaggttttgctttttggcctttttctagcttaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctanttcttggagttttggggaggtgggaggtaacaccacaatatctttg

SEQ ID NO: 19121 - DNA, 203 bp, Homo sapiens
ttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactacaaaaaaaaaaaaaaaaagg

SEQ ID NO: 19122 - DNA, 439 bp, Homo sapiens
actcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgkyaaaaaaaaaaaaaaaa

SEQ ID NO: 19123 - DNA, 445 bp, Homo sapiens
actcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagavttcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgaaaaaaaaaaaaaaa

SEQ ID NO: 19124 - DNA, 427 bp, Homo sapiens
ttctgtggtctgatcttcctgcggctgaaccgcccggctgagccgacattgccggcgtcttggcgattcggcccgacgagctccgctttcactacagcatggtggcctactggagacaggctggactcagctacatccgatactcccagatctgtgcaaaagcagtgagagatgcactgvagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgkcttgttcakaaattgacaatgtcaataaattgaaatatggttcactgccaaaaaaaaaaaaaa

SEQ ID NO: 19125 - DNA, 448 bp, Homo sapiens
aagtgcacggaggagttctgggggccaggcggcgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcag

SEQ ID NO: 19126 - DNA, 406 bp, Homo sapiens
ggagttccgggggccaggcggccgccgcgagtctggtatcctgagcttcgtgagttgagcgctgctgckccgcggtggagtyaasggcaccgctcccgggatcatggtgttctackkcaccagcagcagcgttaattcatctgcctacactadktacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggkctaacctgaagaaaacagctgacatggatgtggggcagataggctttcacaggcagaaggatgtaaaaa

SEQ ID NO: 19127 - DNA, 514 bp, Homo sapiens
acaggtaatatgaagagaaactgaagaacattgctgagagcagtgctattagaatggatgaatttccttttatttatttttaaaggcttccttattcctctcagtaatgttattgataatgtgtttaaaaattgttagaaagagaactatttgaaatctaaagttagtcgtgttttccatctttaaaacccactacaaagggtttatggaggatctgagatggttagcatatccttattgcaaaagcgttgatgtctcaatacagtgcccttaatgtaattagagacaattttttaaaatccatgctgataaatgtcaggctggtctggtcttgtgagttgggcacaaaatgtaccaattgttgaatgatgaaggccagcatatgtaataataactaaggtcagtaagaaaaatattcttctcaattgtatatgttttgttttcaaagtttcatcagactgagtagccatacttaattagcccagaggcagatgaaagctcatttaggcacaag

SEQ ID NO: 19128 - DNA, 469 bp, Homo sapiens
aataataacaaataaaaattaaaaaaaaaggacctcacagggttttatgagaatcaaatgaggtaatatgtctgaaggtactttataaactaccaagtgtatgtaaatgtaatattgtttgttttcttactttgaaaacctgaatttcagggaaaatctgcccagtcatttcaagttcaaggagtattgtccccaggtcttcaggaacctccgtgatcgatttggcattgatgaccaagattacttggtgagagtccattaaggggtgagggtagccctttctccccagcaactgaggagtactatttgggacagccatatttggagaaatgagagtcttggcaaatataattctttacctttttgtgattgcagcattttcaaaaatttaatgaaaattataaaccttgtccttgggggaaaagatgtagatacattaagaattttggccaggcgctgtggctcacgc

SEQ ID NO: 19129 - DNA, 566 bp, Homo sapiens
ctaagaataggtattgttggaatatacagtttgtatttgtctgctgtgaatcataatcttgaaatttctaatcaagtttgtaaaatttttatagtgaaacattttaatgacaatttaaaaatttatcttctctaaagaatggtcaaaacaatatcctttcagaaatagaattgttctttaatatctttccaaaatgactttggttaaatggaccagatgtatattagttaaaatttaggactaagttgttgatattctttgagtttacaagttaatccttattggagatgtgccaatatacagttagaatatcattaatttgcactgtttggggaccccatttaagaatgctgaattttgccaactaagaagtaagcaaatgcaatttaaaaagtaaatttgagcattctgtattaaatatgtgcagttattatcacatgaagaaacgcagtgtgtcgggctgtaatattaccatatttgctgtcatgttctcccatctcagtgctgggaaatcaccatgtggaaaccaagcaaacgtgttgtgcatcagccggcttgagtttgtt

SEQ ID NO: 19130 - DNA, 517 bp, Homo sapiens
caacaagagagctcattggggcctgacaagagtttgttcaaggggagaatcttggtaagctctcacttcaccctatgagaaaaatgattcattgaatagatgacatttgaaaagggaactgaagatattcagtctgtttcttctgggcattgtccacgggacacaaatgctcttttctgcaactagaggtaaattaaccatccctaggtgggagtgcagagtgcttggatcatctagtgaatggaggatgtgtaaatatgactcaagagtggattcactacgcagttgcagtaatcaagacatgcgggcacaatgataaacatgttgtgcctgtaatcactttgggaggccaaagcgggcggatcacctgaggtcaggagttccacaccaacctggctaacatggtgaaacccatctctactaaaaatacaaaagttagctgggcatgatggtaggtgcctgtaatcccagctaatcgggaggctgaggcaggagaatcgcttgaaccaggaggcag

SEQ ID NO: 19131 - DNA, 458 bp, Homo sapiens
tttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatktctggcacattgcaatcctcaaacatgtggttatctttgttgtattggcataatcagtgacttgtacattcagmaatagcatttgagcaatttttatcagcaagcaatattttcagttaatagggtttcaaaaatcatgtaaggatttaaactt

SEQ ID NO: 19132 - DNA, 136 bp, Homo sapiens
ccctttacaccgcatgggcggacacttggccaccgccggggccttggggtgagcacacgctcaggaggatggacctaaagaaacgcttttgcaagccctgaaaacaacagtgatgaagtagaactgcatgtaacaa

SEQ ID NO: 19133 - DNA, 500 bp, Homo sapiens
attcctaggaaaaatgttgccctcttgtctcaagttctatctttgatccaggacgagggaagcctgtctgccagtctgcgaggctgatgctttttccccctcctcttccacctctgttttttcccaacttgctttaggattagcctccatctctctcgaccccaaacagtggaatttggctgtgcttgggtcgtcttgctttgcaatatcgcctatagttgttggcggttttctgctgaggctgagccgtttgctccagcctccgactaaactcattaagttgggagatttttttcaattggacgggtgtttttaaagtctcgtctttccagccccaaacaaggtgtaacaacgcactcttccttctaaggaatgagatgagagacaaggatcactccagacatctcctacctacggtttggggttttttttcttaaaggcgaggcttgcattcctcagcagctatgtacaaagctccctgaaaccttgtctctctaaag

SEQ ID NO: 19134 - DNA, 429 bp, Homo sapiens
atttttttgaatcctgtgggccgttgaatgtggctgctcgcggtcggcgtgccccgacgtacagcgggccgggaaaagtggcactgaggctctggaacttctgcccagctctccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagttta

SEQ ID NO: 19135 - DNA, 682 bp, Homo sapiens
attgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaag

SEQ ID NO: 19136 - DNA, 484 bp, Homo sapiens
ggatggttggatggatggatggatggatgagcgagaacccgcgcccgcgaacaaagagcgaaccaaagcgatgcttcgaatttktaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttgggggcatgttggttctggggggacacctctccttgcattcaggggctgtgaa

SEQ ID NO: 19137 - DNA, 142 bp, Homo sapiens
aggatcacaatctgctgcatatgcatgaggggacccggccgcgcttcgaggctgtccacactgcgcctgataaaaattattcgggcttgaagatctcggggctcccagagttttgtaaaagtgcatacaaagtcctcaaaaa

SEQ ID NO: 19138 - DNA, 554 bp, Homo sapiens
ttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtcygcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaagagaagagaatttcctgt

SEQ ID NO: 19139 - DNA, 466 bp, Homo sapiens
ggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtaccaccttggggggcatgttggttctggggggacactctcttgc

SEQ ID NO: 19140 - DNA, 440 bp, Homo sapiens
acacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcagagctgacatggacccaaatcctcgggccgccctggagcgccagagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaac

SEQ ID NO: 19141 - DNA, 355 bp, Homo sapiens
tataattagaaaactattggctttcaaacaactaagggccaaaagcagcaaaaatgaatgcacaattaaaatgagttcctattaacaaaacaaatttactgtaattatgatagctaggtaatccttgttctcttatatatttatatatacttactagtggcaccaaatattagtatacccagtttgagatgcagtttgttgaaatatatttggacacagccgggcgtgatggctcacatctgtaatcccagcactttgggaggctgaggtggcaggatcgcttgagcccaggagttcaagaacagcctgggcaacatggtgcgaccttgtctctacaaaaaaaaaaaaaaaaagg

SEQ ID NO: 19142 - DNA, 400 bp, Homo sapiens
aaaaatggcaattccctatccctaatctagtactctgtttcttactctgccttactttttcttcataccgtttatcactgccacaaccaaccactactactactacttatttacttctttattgtgaagttcttatcccagaacataagctctttgctcttcatttactcagtaaacatttgtttgttgaatgaagagaaacatagagattatgctatatattgctgaggaaatttaagagctcatcttagaaagttttgttggagaaaagatcttttaaaaatgggctttgattgaagtatagcatttggagagaaaggatgtaaccattctaaactgggaaaatagcatgaggggagacattgggtctggaataaggkaagtgtgtatgggatgagga

SEQ ID NO: 19143 - DNA, 196 bp, Homo sapiens
gataattgtttgtctcctgcagctggcaatgtgccttaacgaaatagctatgtagtaagtgagttgctgtctacatgttttatgccacaaaaatgaatggagtatgccaagaagtgacaagtgtgagagggcagataagtttatttagccataatgtacatgacatgtaaaatattaaaatatataaatgcaaaar

SEQ ID NO: 19144 - DNA, 249 bp, Homo sapiens
gataattgtttgtstcctgcagctggcaatgtgccttaacgaaatagctatgtagtaagtgagttgctgtctacatgttttatgccacaaaaatgaatggagtatgccaagaagtgacaagtgtgagagggcagataagtttatttagccataatgtacatgacatgtaaaatattaaaatatataaatgcaaaaaaaaaaaaaaaaaaaaaaaaaaaaaaaaaaaaaaaaaaaaaaaaaaaaaaaaaa

SEQ ID NO: 19145 - DNA, 486 bp, Homo sapiens
acacacacgagttggtggttgtgctgcccggagcctccagtccgcgagtgtgaagaacggaccagatgggtccagcagtgctgggtcaaggccaggaggggcagccggaagcgcgcgcatgctctggactcctgcagccgccgaaacggtcaggttttccttgttcccgcatgttcagccaatcgtgtttaaggagaaactaacaatgaaaacggactcgttgatggaggaaaagttggaatgcagcctctggtgctgtttgagcgatccctctatcccgggtcgctgctgtgttctggaaaggcgcattgtaccctggatgcagcaggtgtctctgggttaaacaggaatcctattcatcttcttcaccgatatggtctgtggactctgatgagccaaatctgacatcagttctggaacgtctagaagatactaaggagaacagttcggtgaggaaagaaaccaagctattttctcttttcctca

SEQ ID NO: 19146 - DNA, 465 bp, Homo sapiens
ggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactvrtgtggggaagggcatggacaagaagaaggcagccgatcatatgaaaccttttcttgatgattctactctccgatttgtggacaaactgtttgaggctgtggaggaaggccgaagctctaggcatccaagtctagcagtgacaggagcagaaaacgagagctaaaggagttccaggaagcgctcgcccctggccgaggatatgtccttgcaaaacacgagccctcctagtgaagaggggatgtcacccaaagcctaccaccgga

SEQ ID NO: 19147 - DNA, 480 bp, Homo sapiens
catctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaacccctctctactaaaaatacaaaaattagctgggcgtggtggtgcatgcctgaaatcccagctacttgggaggctgaggcaggagaattgcttgaacccgggaggcggaggttgcagtaag

SEQ ID NO: 19148 - DNA, 406 bp, Homo sapiens
acatcggatcgcagggctcccaaaatggcgagtgaggctgcggggactcgctgagcagcggagggggagcgtgcagagccgctgcggccctcacagtccggagcccggccgtgccgtgccgtaggaacatgcacttttccattcccgaaaccgagtcccgcagcggggacagcggcggctccgctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagakaagtacatgcaagctgttcggcaagacccattggcttgg

SEQ ID NO: 19149 - DNA, 337 bp, Homo sapiens
tattctagaaaatgtattatgcatatgaaggatttggttttgtctaactaggggggacacgtgagacacttccaagtttacagattcaggcagaaattgtaaagtcctatagcttttgcatatgtcaaattggcaagtccgaaaacaaaattgcatccatcctttggttatggaaatgttgtaggtattgctaaacaggctgctgaatcaggagcaagttagcagagacattgcatgtttcatgttgctacttgctaaggtatttttcaaatgcagtgggcggtctgaagagctcctgtgcccttgactgtctactttctgtctttttttttttttt

SEQ ID NO: 19150 - DNA, 515 bp, Homo sapiens
  misc_feature 199: n=a, g, c or t
aaaaatgcaaagcaattctagcttcttgccgtaggcttattattggtggcaatattggtattgkaattttgacgctatgctataagtaaatatgttaatgctattaggaaccaagattttcagtgtaaaagaaaagagataaaatacaaaatcaaagaaggtaagagaaaactttagaacattgatttcttgctctggnattktktttttttwtttttttttagccttgctctgttgcccaggctggagcccagkggcacgatcatggctcactgcagccttgacctcctgggctcaaacgattctctcacctcaacttcctgactagctgggactacgggtgkgcaccaccatgctaggstaatttttgkattttttgtagagatggggttttgccaggttgcccaggctggtctcaaactcctgggcccaagagatctgcccaccttggcctcccaaagtgctgggattacaggcatgagccactgsgcctagccagaacattgatttatagg

SEQ ID NO: 19151 - DNA, 258 bp, Homo sapiens
aagcccctcattttggcagaacttaccatgtcgaccagccgcaaattaaagagtcatggcatgaggaggagcaagagccgatctcctcacaagggagtcaagagaggtggcagcaaaagaaaataccccaatcgcaattaccgctcccacttgtgakcccccagcgggctctgcctggtgcgcttcacacagcaccaagcagcaacaagaacagcagaaggggaactgccaaggagacctgatgttagatcaaagcca

SEQ ID NO: 19152 - DNA, 391 bp, Homo sapiens
  misc_feature 391: n=a, g, c or t
aaaagcccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgcctggtgcgcttcacacagcaccargcagcaacaagaacagcagaaggggaactgccaaggagacctgatgttagatcaaagccagagaggagcctatggaatgtggatcaaatgccagttgtgacgaaatgaggaatgtatatgttggctgtttttccccagcatctcaataaaacn

SEQ ID NO: 19153 - DNA, 455 bp, Homo sapiens
attggatgagagtagcccacactcaaggaaagatgaaactagctcacctcttaaagtgaggtgtattacagaatgtggcattatgtttgctggatcccatatctttctcttttgtgattttctcccttgttttggtggtacatactctcatatccgagtgtcttcttgagcatgggctgccttggagaaataaatgttagctgagaaggaaactttctaacattccagaaattctgagtgccaaaactcatctggccccaaggatcgggaaggatattgcagtcctgcgatttacaaacatgtttcctcccagagtcaccccaatctccatgagagtgtgaggccatggaagcaaaaccctcagatttttgtcttttctctatcattcattatgtgatctcaaacaagtccaccaaactttttccccaacatctcaataaaactttgaaagcaga

SEQ ID NO: 19154 - DNA, 390 bp, Homo sapiens
aaaagccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgcctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaacb

SEQ ID NO: 19155 - DNA, 351 bp, Homo sapiens
aaaaattaaagaktcatggcatgaggaggagcaagagccgwtctcctcacaagggaktcaagagaggtggcagcaaaagaaawtaccgtagggcaacctgaaaastaggaaacggggcgatgacgcaatcgcaattaccgctcccacttgtgagcccccagcggctctgcctcggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgttttttccccaacatctcaataaaacttt

SEQ ID NO: 19156 - DNA, 389 bp, Homo sapiens
aaaagcccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgcctggtgcgtttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaa

SEQ ID NO: 19157 - DNA, 390 bp, Homo sapiens
aaaagcccctcattttggcagaacttaccatgtcgaccagccgcaaattaaagagtcatggcatgaggaggagcaagagccgatctcctcacaagggagtcaagagaggtggcagcaaaagaaaataccgtaaggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaa

SEQ ID NO: 19158 - DNA, 427 bp, Homo sapiens
aaaagcccctcattttggcagaacttaccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcacaaaaaaaaaaaaaaaaatgcgaaa

SEQ ID NO: 19159 - DNA, 453 bp, Homo sapiens
gaatttcagtgcctatcgggcagccagtgaacatttgtccatctttaaggcattaaactgagaagaaccactgaggaaagcatgccacagtctttcccaaaatccctgtgtcttaaggaacaaccaagaagttaactggtcagggaaaagatttcttttggaacgcagagaatgatgggagttgtgatccatacctccgtgtgcataatggttgtacctgctccaggaaggcgctggatcctcccaactccatgggaagagattaggacacaaacaacagacagaaggtgaccacaggaggacacagtgagaagctggccatctgcaagccaaggagagagacctcaggagaaaccaaacctgccagcaccttaatcttagacttctagccctcagaacggtgaggaaataaatctctgttgttcatgcaaaaaaaaaaaaaaaaargctttg

SEQ ID NO: 19160 - DNA, 494 bp, Homo sapiens
gaaaaattgctgccaggccctccctcttggaggcagctctcacaggaccctgaaatcttggcctgagattatttccaataactaaatgcagatttgagcaacaagagtcttgatgggaatgttctaattcgtgtctctgttgcaaacctgtcctttcccacagccaatcgcaattaccgctcccacttgtgagcccccagcgggctctgcctggtgcgcttcacacagcaccaagcagcaacaagaacagcagaaggggaactgccaaggagacctgatgttagatcaaagccagagaggagcctatggaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgt

SEQ ID NO: 19161 - DNA, 550 bp, Homo sapiens
acaccagagatggaagtacatgtgatacaggtgtatccctttctgcctgtttttctccctctcataaagcagaggtttgccctgcatctgagaaagaattagaacagaactttcctccatttcattccccacctcactacacttgggccaggcagcgttcgccagtcatggcacttcctacyaagtctgaatgctgtctcagaaacttgctcaacacagccgtatggaccatcacccccaactgactagaattagcctacaagaagaagttttctttcaccttagtgagataatttattatggccataagtaactgaaatgtagcatttggggatgaaaagcacagttaccagccaaagactccctgggggatggcggggggaatatgggcctgtgcgtcagaaagccccaggcacactttcatcaacttcgataawksmrrrggrammmcmrrrgrmskttttyytymamyyyksmmmrsywwttgactctattattttctgaaggcaaaaatgcatgtttgttagaatggaaacagaaaaacattaaa

SEQ ID NO: 19162 - DNA, 623 bp, Homo sapiens
acaccagagatggaagtacatgtgatacaggtgtatccctttctgcctgtttttctccctctcataaagcagaggtttgccctgcatctgagaaagaattagaacagaactttcctccatttcattccccacctcactacacttgggccaggcagcgttcgccagtcatggcacttcctactaagtctgaatgctgtctcagaaacttgctcaacacagccgtatggaccatcacccccaactgactagaattagcctacaagaagaagttttctttcaccttagtgagataatttattatggccataagtaactgaaatgtagcatttggggatgaaaagcacagttaccagccaaagactccctgggggatggcggggggaatatgggcctgtgcgtcagaaagccccaggcacactttcatcaacttcgataaatgcagagggaacaccagaggacgtttttcttcaactctgcacagctattgactctattattttctgaaggcaaaaatgcatgtttgttagaatggaaacagaaaaacattaaaaagttaatyccttaacacaaaaaaaaaaaaaaaaaaaaaaaaaaaaaaaaagaaaaaaaaaaaaaaatgcgaa

SEQ ID NO: 19163 - DNA, 505 bp, Homo sapiens
tttgttgaaaggtcaacatgggtgtttggaagaggtaatgctaatgaggtattcgtaaaattggaggtaggcaactttgcttttgatacccgttatcaccattccattgccccagtaaatgtaaattccttaagtgtttggcacatacgatacgacgtccaatagatacttgttgaataaggtaactttttccttctttttgattattccctgagaaataagtgtcctggtgctgccccctggtggctaaaggatcccttcattgggagcccaaaccctccttggcaatgccgtgggctgggaacatggctctgtttgactgtatagttccccttcctcacaaaggatattaaggatgttaaagggtatcagtggtatagataagagaaatacgtttttctttcttttaaattctatatttgatttttaaaaactttatccaagtgggcgtgaaagtcttaataaaaatgcctacgaataaaagggttacatggacatgtgcaaa

SEQ ID NO: 19164 - DNA, 435 bp, Homo sapiens
tgttaaatattaatgacattgaatgtgcttaatggttttgtggtgatgtagaaaagggtttctcaatcttggcattattggcaaactggaccggtgcatgctttgctgcggagagtgtcctgtgcattgtgggtgctgagcagcagttctggcctccaaccgccagatgtcgagagagcttttccttctcccattgagacaaccaaaaatgactctagatgccgccatgtgtcccccggcgcgcaaaattgccccctgtttgacgatcatggtgtgagacgatgttatcattaccagtagattcatactaaaatatttcagggtgaaattttcacagtttattttcagatagcttaatcagaattgaaaacaggataaaggcaaaaagagaacatttttgaaaaaagaaaagaattaaaaaaaaaaaaaaaaagg

SEQ ID NO: 19165 - DNA, 497 bp, Homo sapiens
tcgcttgcggctgacctttctttggaatgtcgtgagttccatttgtcccagaatacggtccgctaccgctgtgacatgagtgttagggaaggcgggttgtcacgtttctacaagccttccagtcaaaagggaaaccttgcctaagtccttgtagttgagaaatctctaagaggtggaagcaaatactgcacatgcgtgttggtcctgtgagggaaaccagctagtggagagggagaggttgaaggaacagaaaaatgagaagacaactcactggtagagtaacttggaatagatagaaatgggatcctgggcacgtattagttgtggggataggagaatgaatcctttatctgtgactcctgatggggtaaaaaaaagattatggataatcataagctcaggtgtgaggtagggcagagagaaaaagaaggaatttgcacctgatggcttctgttttctctgtaaagttggtgacagagttgtcagtttagtgtaaa

SEQ ID NO: 19166 - DNA, 497 bp, Homo sapiens
aattttagcttggcaaacttgtttcatcagtatctgggcctggtactatgctgaactaggtggtagaaagaaaaatgagacatggccctcatcttcaaggaccttggggtgtaaggcaaagatgcattaattagtggagatatgtcaaatatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatc

SEQ ID NO: 19167 - DNA, 369 bp, Homo sapiens
aaaatgacatttagttattttgataatgcaacctgtgtcgattctgctggcatcctcaatcagtccaagtaaaagaaatacaggaagggagagggcttttatttttaaattaagatggcagcattaatttcactaagtgttcttttagaagtaaatgttggaaaatcagcaggaacatgggtgtaatgctttctggtcctccttccaagtaatgccatgagctttgacggtgctgtaattaaatagaaagcaaaactgtggtaagaaaggagtgtggtttgaagtggaaaaattgacagtgctgttaagattccgtgaatggtacagattcatctcttctccgagtgccttcaaaaaaaaaaaaaaaaa

SEQ ID NO: 19168 - DNA, 400 bp, Homo sapiens
atcattttccctgcaggacacccggcctcggtcctgctttagtattcatcccagcttcattactgcagccacctcgcaacccaccctgggcagctgctaaaagggggaaaaattaaagcaattcatactcctggtgacttactgctgcagaataattggtttctgtttgcaaggaacattatcacagcaaagcccagaaaacagaaagggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaattcccccaaagctccaaaaaaaaaaaaaaaaagg

SEQ ID NO: 19169 - DNA, 144 bp, Homo sapiens
atggaatgtagcaasactccttttatagatgagcaaattgagacccaaagccgttaaacaacttgcccccgacagtgtgatattctctccctatctcgttcgaatttccgtctcgattttaaaaattgagaagggagagaaaaa

SEQ ID NO: 19170 - DNA, 434 bp, Homo sapiens
  misc_feature 393: n=a, g, c or t
gatttcacgttcactctgtaatggctgggggcttcagtaaaatacttaatctccctaagccagttttttcrtctgtaaaacggagctaataataacagtcttaccttgtgtaaatggcacagaattattatgttttctgtgatttacaaagagcatatatgaatttaataatcagaaaagatggcattctagatttaatctctaataaacctaatttcaatggtgggacatttaatgcaaattttcatcagaaaggaaagggatggaggaaagtttaccaagcaaatggaaaatagaaacaaatgggttataatcgtaatttctgacaaaacagastttaaaccaacaaagaccaaaawaagacaaagaaagacattacataatggtaaagcngttcaattcagcaacgaagastaactatcctaaatatatat

SEQ ID NO: 19171 - DNA, 151 bp, Homo sapiens
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaa

SEQ ID NO: 19172 - DNA, 170 bp, Homo sapiens
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaaaaaaaaaaaaaaaaaaaaa

SEQ ID NO: 19173 - DNA, 162 bp, Homo sapiens
atggaatgtagcagactccttttatagatgagcaaattgagacccaaagccgttaaacaacttgcccccgacagtgtgatattctctccctatctcgttcgaatttccgtctcgatwttaaaaattgagaagggagagaaaaaaaaaaaaaaaaaaaaaaar

SEQ ID NO: 19174 - DNA, 532 bp, Homo sapiens
aatcatgcaatcaaccatttactgagaacctgctttgttgctcaactctgtgctggcgactctcaggaagacagggaagggatcttggaagccccatgttgaaggtggcagagcaacaaaaattgaggaaaccctgaatccctgaattactatttggagatgaccacccactaattcggaacactcattattgggctttaggagaatgagaagttctatcatgtttgagactccgtacatctttggatttgttttaacagctagttttaccctggctaacatggcaattgacagcctctgagaggagatttggagaatctgcttttttaacaagtactccaggggagtttgagaatcactgctgaaascaaggggagccagccacccaaggatttaacgctgaccaaggaacaccacgctatttgcattttagaatgacagcaagggagcagaactctgcccccttcttgtctgccaaggagaacaatctactgactcaaaagaaaagaaaactttggtaagagaaaattga

SEQ ID NO: 19175 - DNA, 519 bp, Homo sapiens
  misc_feature 483,503: n=a, g, c or t
gcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcgtatctgtgatctgtgaacaggacctttaggtgatttgcatacactgtaaactgtgaaagccatcagtgtagtggaaggagcatagaatttagagtagagagacatggttttggaccctggttcctgctttccttgtttcatctgtgctgccttagaaaattgtcatgagcccgggcgcggtggctccggcctataatctcagcactttgggaggccgaggctggaggatcccctgaggtcaggagttttagaccagcctgcagtcttaaccanaccttgtaccaatttaacanttcattatactctgtg

SEQ ID NO: 19176 - DNA, 658 bp, Homo sapiens
gcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatrcactgtaaactgtgaaagccatcagtgtagtggaaggagcatmgaatttagagtagagagacatggttttggaccytggttcctgctttccttgtttcatctgtgctgccttagaaaattgtcatgagcccgggcgcggtggctccggcctataatctcagcactttgggaggccgaggctggaggatcccctgaggtcaggagtttgagaccagcctggccaacatggtgaaacccgcctctactaaaaatacaaaaatttgccaggcgtgatggcaggtgcctgtaatcccagctactcaggaggctgagacaggagaatcgcttgaacccgggaggcagagattgctttgaggcgagattgcaccactgcactgcaacctgggcgtcagagcgagactttgtc

SEQ ID NO: 19177 - DNA, 303 bp, Homo sapiens
aaggttgttttttcccaggaggccgactccgccgagtcggtgrcggctgcaggctgggagggagaagtgctacgcctttgcaggttggcgaagtggttccaggctacccggctagtctggcacggccccgtcttctgcctcctcctccgtcgcgtggcggcgggaactgttggactgcgcggcctcgggaacggcccaggtccccgcccgcaggtcccgggcagataacatagatcatcagtagaaaacttcttgaagttgttcaagaaaaatttgaaagtagcaaaaaaaaaaaaaaaaagg

SEQ ID NO: 19178 - DNA, 369 bp, Homo sapiens
ttgtttttaaattacactactggtgatagaagtgtatgtcaggtaggtagatggtgaatgaatatttgacttaggacagcaaactggcatggcagctgtacagatgacctggcatttaatcccaggtgtgtttgagcccaccatctggaagccattcctgaaaacaaacacgatttctctaccttttgttttcattttcaactgtgaggtttgtatttcagtttagaaaatactcaagttgggccgggtgcagtggctcacacttgtaatcccagcctttgggaggccgaggtgggcggatcatgaggtcaggagtttgagaccaacctgtccagcatggtgaaacccgtctctagtaaaaatacaaaa

SEQ ID NO: 19179 - DNA, 500 bp, Homo sapiens
tatactgatgacatacagatttagtcctcatctcttccttcaactgcaggcctctgtgtccaacttccttcttgactcctccacttggatgaataataaatagccgcctcaaatattttaaagtccaaaacaaacccttcattgaactgtttgttccctcttttcaaccatgccttgtccatgtggacacccccaccccaaaagtcatccttgatttctttttctttaccccctctgcccacatccaacccatcagtaagtcttgtcagttctacttccaaattatgtttttaatgttattcccatttctcagttccactatcaccaccacgactatttcttgccatagtctcatttcttgccatagtctcatttcttgccatagtctcctaaatggtctcccagtctctagtcttgctgtcttataaattcctctccagtcagtagccagagttatctttcataaaatataattttaattttacaaaaaaaaaaaaaaa

SEQ ID NO: 19180 - DNA, 293 bp, Homo sapiens
cttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgttgaaagacatatgctatatcccaaataataaaacaaacgagatccctggggctcattcatgtgacttttcaataaagtatgtagactgtctaatataaaaaaaaaaaaaaaaa

SEQ ID NO: 19181 - DNA, 558 bp, Homo sapiens
attttgggaagagctttgttatggttgtggactagccgcctctgccgggtcgacaagctggggacgcgtcctcagacgagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaa

SEQ ID NO: 19182 - DNA, 471 bp, Homo sapiens
taaatattgctcctcagccagccccgctacagagcctggtatttcctcttttaagaaattgagagcaagtaccttttacctgggaaggggaaactcatcaaatgctatctgctcttgggacccaatcctgagttactttatcagattaacctgatagtcaccagaactccattcaaacagaacacaggactgttatatttgggtcagtaaaggacaaagatctggtgtctggactgcaggtgctgtggtatcgttggaagcaaagatggaaaacaaagcaggagatgaagggttcatagagataaacttcttcctattttgcctgggattccaggtagcagaactggagctcagacctcttttggggggatcctaagcaatacttttgctgctcccttctggtccacatcacaagtctggagaatctaaaacaagctgggcaatgagaaaatctaactcttcatgtgttat

SEQ ID NO: 19183 - DNA, 563 bp, Homo sapiens
taaatattgctcctcagccagccccgctacagagcctggtatttcctcttttaagaaattgagagcaagtaccttttacctgggaaggggaaactcatcaaatgctatctgctcttgggacccaatcctgagttactttatcagattaacctgatagtcaccagaactccattcaaacagaacacaggactgttatatttgggtcagtaaaggacaaagatctggtgtctggactgcaggtgctgtggtatcgttggaagcaaagatggaaaacaaagcaggagatgaagggttcatagagataaacttcttcctattttgcctgggattccaggtagcagaactggagctcagacctcttttggggggatcctaagcaatacttttgctgctcccttctggtccacatcacaagtctggagaatctaaaacaagctgggcaatgagaaaatctaactcttcatgtgttattcccaataaatcagttatgacataaaaaaaaaaaaaaaaaaaaaaaaaaaaaaaaaaaaaaaaaaaaaaacaaaaaaaaaaaaaaatgcgaa

SEQ ID NO: 19184 - DNA, 385 bp, Homo sapiens
gtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatggg

SEQ ID NO: 19185 - DNA, 88 bp, Homo sapiens
cattttagatgtaacctcgggtatggtgaaagacccaccggacgtcttggacaggcaaaaatgccttgacgctctggctgctctacgc

SEQ ID NO: 19186 - DNA, 513 bp, Homo sapiens
catgtgtaacttgatgtggtggatatgaggatactttcagttttgataacagaaaatgcaactcaaattagttaaaacaaagggaatttgaatttgaattacatacgcttatgtaattgaaaagaccaaagggagtgagggcccctggcatggtttgatgaagggtacaggctttggccctgtttttctataattctcttggctttaccctgtattagcttttttttctcaaacgggcttccccagtagtacaagatggctgcctttgtatgtttcctcattcctggagagraagtagatgcttcctacaaatacagtgcaaaatcctaagcttgacactaattgaaccatcttgtgctccaaaggatcactgtcttaaaatctgggtagctttctgtgtctagaccagtggcttttaaacttgagtgtgcattagaactacctggaggacttgttaaattacagattgcagccgggcactgtggctcatgcctgtaatcccagcactgttgg

SEQ ID NO: 19187 - DNA, 464 bp, Homo sapiens
ttcacttaatagtccaaagtctcttaaattcctgctgcagacatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcctaatttgatcttgatgctcttgaggtaatttacgtccatggtacctgtgtggtggaattactatataagatggtgtgctactgtgcaccttgtctcatctccactcttcgtgatagcatgttggtagcttgaaatcagcctggtgggagtattaccatggacactggcaaaagctacag

SEQ ID NO: 19188 - DNA, 472 bp, Homo sapiens
tcgagacctgacggttttatgaggggcttttccctcttttgctcagcatttctccttgctgccgccagtgaagaaggacgtgtttgcttccctttctgccatgaatgtttcctgaagcctctccagccctgtggaaataaatgattattattcttcaagaagaaatccactaacagcatccttttcagaatgaagatctgaaaaggaagagattatctcctctttaatgctgtatcccaaagcctagaagaaccagagacttactagctaatcaataaatattgctgagtaaataaatgacagacatttgcatgcaggcctcaaggagcagctgaagtgatagaggtagaatgaggcaataaattattagcaaagagagcggagtatttacaggcagcgatatactaatgaacctaaaaatttggagaatatttggaaaaataaaagagcttgcatccctggaatgcaacga

SEQ ID NO: 19189 - DNA, 473 bp, Homo sapiens
ttactgttgcttctatatgatgtaaactttaaaaattaaggctcaaattttagaaatacacagaggacaaacatacactctaaaacatgtttatttcagtctaaacaaatgttttgtttatggatattagtgtttttgagaaatcactcagaaaatgttacttcatggccttgcaatgcttgatgttagtttagcacatacaagtgcacttttatacccattgtttaggaggttttatttttaaaattttcttttggataatctcaaaacaataaaggcatttagtgagtacaaatttggaaatcccattttatttttatatctattttcattgtttatcttattgtttgagacagaaattgttaccatgtgatgatgatttccctgttgttttactgtacaaatatctgcctaattgtaaaattatgaatataaaattttaatattgtataataatctttcttggaggattt

SEQ ID NO: 19190 - DNA, 518 bp, Homo sapiens
aaacaaccacagctttttcaaattcaaaagccagatgattttgacatgactagcagattcatatagttgcaaattgggcaataattagataattgctaaaatactcacaaatatccaggtatggtgacagcaataatatgaagaataaccactaacatttattggacactttgcatgtaataagccttctttgaagcatttgcatggacattactgagtactcacaataaccaatgaaatgggaatattattaaccactattacaggggaggaaacaaaggtccaaaggctttattaaattgtccaagtcacacagtttggaaaaggcagaattgggattacaagttaagagtatcttatacatcattagtactaaaaatgtatattgattagagctgctgaaggctagtggtgaaataactcaatttaagtcagaacaccttgacttagtcttaccatgtaaacaacacctaccagttaatgagaaaagatgactactctaatggagaaataagcaa

SEQ ID NO: 19191 - DNA, 380 bp, Homo sapiens
  misc_feature 269: n=a, g, c or t
aaccgcccaacggctgaggagtgcggcagcgcgccagagactggcgggcagctccgcccgcggccgggatgcactaggcaaagccagctgggctcctgagtccggtgggtacttggagaacttactacgtctagctggaggattgtaaatgcaccmaatcagatgctgtgtctagctcaagattttctccatccccttattttgggccagtggctgtcattacatatgagatgagtctcttgaagactacagatgggctggtgaattanbrgatctccgtcaagtgcagtaaccagttcaagttggaagtgtgtcttttgaatgcagaaaacaaagtcgtggacaaccaggctgggacccagggscagctgaaggtgctg

SEQ ID NO: 19192 - DNA, 449 bp, Homo sapiens
agatgtcaataggggtttgaaaagtttcacatatccttaagaatctagaaggctacatgcatatgttcagctatgggcatgacctcatggctgtgggtatgcttaggaaaggcctgaaaaggcctaagctttcacctctggctaaccttgaggctcaaawkggaaagcaawkggtaaggcagttgtcaactgcykggctgagtgttaaaggcatacctcaacacatacacagagcccatcattaaagtctggaaggcatactagttataggcatttaaagaaatcattgtccaatcattagttgataactaatctaattgagcaaaaattttagtggtcacatacaacaaagaatgcaaattgtacacaatcagttcagaataataacarcacaaacagcaatgacaacaaactcttgggatgacgtagaatctgatttaagagttgac

SEQ ID NO: 19193 - DNA, 214 bp, Homo sapiens
ttacatgagaagatgtccctagcatgtcattgaagaaggaaaaaataggcattggagccagcatgtgcacatagcactgagctgatatatacaacatccttatgtatgaaactgaacatggatgtctgtctacaagtgtttctttgtatttgcaaggatgtttgcaaaaatgtcagccctgggtgctaggatttgggacttctttttccgtgtg

SEQ ID NO: 19194 - DNA, 550 bp, Homo sapiens
aaaatgaatattgcctttacttgttattccttccagcagtctcaacacatttagacaaaatatttgtatttgagacacaatctgccgagagtagacaagaaaggcctttatagttagaactggacttgaatttcaatcttgtaactttcaactaatggaaacttgggaatttgatttatttctctcagccagttttctcatctgtaaataggagaaaaaacataattatatattctatttatttatggatgaataaaaggtgaagtttttagcacaatgcctgtcaaggtaggctcattttaaatatttgttagattccctctccttcagtacatctggtattgatctgaaactttacagttaaaaattaatgtaggtgaagaaaatgtaaagaacctcacttaatgatttcttttatttttgataaatttgtccaaatgctatgcataagtaatctgtcttcgagaaatctaaaataaaatgagaagtttgtttatggaaagtcatgataaaataatgggggaaagtattttgctgggagtcagaagac

SEQ ID NO: 19195 - DNA, 165 bp, Homo sapiens
tgttatgtatcaagctgttaccgaattatatcggtgttagccgttgctgtcatcatctccattatccttgtatttcagacatgtgagctttggaaattaaaatctttgaaaatatgaaaaaaaaaaaaaaaaaaaaaaaaaaaaaaaaaaaaaaaaaaaaaaaaa

SEQ ID NO: 19196 - DNA, 444 bp, Homo sapiens
ccttatcaccttgaccacctttgccttatgtaaatttcatctattctataaagtcacctaaaaatacatttttccttaacataactcactttgctttcagaaatagacttaccttaatctaatggttctaaaccggggggtggttttgattcccagtggttatttggcaacgtctgaagacatttggtggtggtctcatctggttggggggtttacaactggcatctagtaggtggagacccaggttgctgttaaatatcctacaacacacaggccagctccccactggaaagaattatctggtcctgggcctggcacggtggctaacgcctgtatcccggcactttggggggctgaggtaggcagatcacttgaggctgggagttcgagaccagcctggccaacatggtgaaaccccatctctactgaaaaaammrwmamwwm

SEQ ID NO: 19197 - DNA, 130 bp, Homo sapiens
aggcattgaggcagccagcgcaggggttggttggagggaggagagaakwcagaggakcacttawkgtgcaaagcagcctattttttcttcaataaaaattgttaagagaaaaaaaaaaaaaaaaaaaaaw

SEQ ID NO: 19198 - DNA, 406 bp, Homo sapiens
caacatcataaacaaattccttgaaaaataaaaagtaccaaaattcattcaagaagaaatagataccagcctgagcaacatggcaaaatcccatctctacaaarsatcaaaaaaaaarraattggtcgggcatggtggtgcacacctgtaatcccagcttgtcaggaggctgaagtgggaggatcgcctgggcccagggaggtcaaggatgcagtgagccatggtctcaccactgcactctagcctgggtgacggagtgagaccccgtytcaaaaaaaaagaagaagtagataatctgaatagccctatatctatagaaacttaatagtgctgggagatataggtattattatcctcattttacagatgtgaaaattgaggctcagagaagtaaagtytattgyty

SEQ ID NO: 19199 - DNA, 315 bp, Homo sapiens
cacgtccagataatttttgtgttttttgtagagatggggtttcaccaggctggtcttgaactcctgggctcaagccatctgcctgcctcagctcacacctgtaatcccatcactttaggaggccaaagtgggaggattacttgagcccaagagttccaggccagcctaggcaacataatgaaaccctgtctctacaaaaaaacttaaaaaattagccaaaacatttaaaaaaattagccaggtgtggtggcatgagcctgtagtcccagctgcttgggaggctgaggtgggagcattgcttgagtctgagaggty

SEQ ID NO: 19200 - DNA, 552 bp, Homo sapiens
catgaaggtcaaggatgaaattctgctgaaatacagaggaaaaagaaaaggtgaagaaagtatcacctgttatgtgctttagagttatgtactgtaaagataaaccattggaacagaagccaatatcagatacttaaagtgaagacatcagaatagaagaaaggatatttacacgcagattaaaagggtttaatattctttaaaatgtgaattaaaatagttttgatttctttttaaggaaagcatgcttacatttgccttttattgctggatttctcaactcatcctagtaggtactaatggagaaagaaacatgttctaacatatcctcagggtttgcctaaagaggtgattttccatcaaacacttacattcactgaaagaaaacagtttatgatgcatctgaaagaaagcatgcttacatttgccttttatagctgaatctataaacccatgtaatatgaatcaatagaaaaggaaacatgtcttakaaaggtgtttctccctyaaacacttccattaactgaaagaaaagttttcatgatgcttttt

SEQ ID NO: 19201 - DNA, 424 bp, Homo sapiens
atagtgtgaaaagattacaccactgtgatataggggaaagggcacaggcctttcaaatccctgccctgccgtctcttaactctgggaccgtgagtgggctgtgtggcatctatgaactttggtttcctcttctgcataaaagagaataatgatacctactagagaattgttgcggtgatttactgagactgaaatgcgcctaatggaatgcggccacgtgagtcttgctgtgtcgtccaggctggagtgcagtggtatgatcttggctcactgcaacctctgcctccagggttcaagtgattctgctgcctcagtctcctgagtagctgggactacaggtgtgcgccacaacacccagcacgttyacgtycacgttcttcccaggaaggctggagactttyacaggaatgacwgcatctatgak

SEQ ID NO: 19202 - DNA, 161 bp, Homo sapiens
atgaattttatttctaagcctttaagttacctttaaaatgtccacttagaaaactgtgttattatgacagatctagaaatagagcagaaagcatccaatcctagtktttccttccatcagdgaactaggaaattgcaatcctacatgtyggctgtcaattw

SEQ ID NO: 19203 - DNA, 467 bp, Homo sapiens
tgtccagggctcgctggaggattgggaaaaagctgatgtggggaaggcctgttctgtagcaactgaaccaacaaaatacgtacgtgaactcaggaaccacatttcctcggtccatctcctgcagccgtgtgacctcagggaagtgcccatgggcttctcaagaggaaacgtgtgtctgcctcatgtgttatttggattcacacacagctgtgtgcccagcacatagtcagcattctgtaggtgtttgataaataagtaacacggaaagcctcatggattcacctagcctgtctctcacagaccttcccaggtttccttcctgagcactggaacctyaggtwccccaaaaccttaggagaaggcttwaattaawttcatgccacctttcagcacakaktwcatttgttggcaaakccattcaggtggaccttcmacaggagccgycttctcatttttaattcttactt

SEQ ID NO: 19204 - DNA, 420 bp, Homo sapiens
rcaaactcctgggcttaagtgatcctcccaccacagcctcctgaatagctggtactacagatgcataccaccatgcctggcttattattattattattttgagataggctcttgttctgtcacccaggctggaatgcagtagcaccatcacagctcactgcagctcaatctcccaggctcaagcaatccctccacctcagcctccagactagtaattattaaattttttgtmsagacaggatctcgttacattgkccaggttggttccgagctcctggcctcaagccatcctcctgattatcygggattacaggcatgagccacagtcccytgccctgctgrwtcttaawcaggctttcggttagtcctyyctgtkyttagctccatstttatccccacttygaaaggtgcctaatgctm

SEQ ID NO: 19205 - DNA, 468 bp, Homo sapiens
  misc_feature 19: n=a, g, c or t
cactttatccagctagtanattcctactgatcctcctattcattctttgagaatcagttctaatctgaaggtttttctccccacttatcctggtctctgccctgaggcagagaatggcgtgaacccgggagagggagcttgcagtgagccgagatggcaccactgcactccagcctgggcgacagagcgagactccttctcaaaaagaacaaaacaacaaaacaaacaaacaggattttcctaacctctttctgacctgatttaaggtctctctggtaactatcatagcctaaactgctgtattctgggacttaccattagagcttcccaaggcaatctggagaattaaaaaggaaagtaaagtgcttgtagtaactagaagaatctgtatatcaaaattccatttaactattaaaacttaaagtaaaattatggttacatgttcaaaattaaacctgaatacttcag

SEQ ID NO: 19206 - DNA, 236 bp, Homo sapiens
caattcttaaatattttattgtgctaacacaaaagttttattttatttggagtgcataagatacagaaacrrttctttatgatcttacatctctgtttttttaatattgcaaataacataccactttgacataggcagtttctcacttacaaaagtaaaatttgaaatgatcagyggtcaccccatctgtatatttktgccaccactaccaraagagccatgtcattaaaaaaaar

SEQ ID NO: 19207 - DNA, 74 bp, Homo sapiens
atgttagctgtggccactgtggatttttcgcaagaacattaataaactaaaaacttcaaaaaaaaaaaarraag

SEQ ID NO: 19208 - DNA, 184 bp, Homo sapiens
gtgatacattctgcatttagaaatatttgcgctgaaagtgtctgagttacttcttctcatttctcttccaggtgttttattccaaacgtctatgctgctttgttcactgcagctcttgykcctttgacgtgcctcgtggtggtgttcgtggtgywcatccatgcctaccaggtgaagccacagy

SEQ ID NO: 19209 - DNA, 299 bp, Homo sapiens
actctagccccctcccgcgggagtcgcggcgctgcgggtaggacccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgc

SEQ ID NO: 19210 - DNA, 61 bp, Homo sapiens
aacccaactcccccgcccgccccgtgcaggctgtggagactcccttcccgggggagggggm

SEQ ID NO: 19211 - DNA, 423 bp, Homo sapiens
agagactcagactgaatgtgagtgaataaaagagttcatgattatgagaattgtgacttctttgggggacttatttgaggacaaacaaatttcctgattcctcgactcccttcagcctcttcccctctgatgaaggcatggggaaatccgttgaagcaaacattctagcatgccttctcttcaaacttccttcatgtttgtgctcggccaggaacctactgccagcagagggaggtagaagccatcatggagggcgacgaggaggacagaggctgctgctgctgcaaaccaggccacttgcctcacctgctgtcctgcaacgctgcctttcacctycgctggctcacctgggaaatcacgcagacccagtacatyctggagggctacagcatcctggacaacaacgcggccaccatgctgcag

SEQ ID NO: 19212 - DNA, 260 bp, Homo sapiens
aattcactttgctgcttgttcgcttctcccttcctcaggcttcttctgatggttttccgtctcctgcccgagcctttcctttaaaaggaaaactttactgcgatacccttttccccttggaggagaggattaaaagttccaagaactggtgccgcccgtgccatttgggcgctgggaaggtgctcggcggcggggttcccggtcccaccatgtgcactaacatagtyttacgagtggctcawagcgctgcagcttccgcw

SEQ ID NO: 19213 - DNA, 164 bp, Homo sapiens
tcccctcgccgcatccactctccggccggccgcctgcccgccgcctcctccgtgcgcccgccagcctcgcccgcgccgtcaccatgagccaggcctactcgtccagccagcgcgtgtcctcctaccgbcgcaccttcggcggggccccgggctbcccgctcggm

SEQ ID NO: 19214 - DNA, 164 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacamaaaaaaaaaaaaa

SEQ ID NO: 19215 - DNA, 146 bp, Homo sapiens
  misc_feature 141: n=a, g, c or t
tttkcaacatggcagccatgcgctggcgaarkcggcagcggctgttaccttggaggytgctgcaggcccgtggctttccacaaaattctgcacccagcctgggcctaggagcgaggacttattcccagggcgactgctcgnattcs

SEQ ID NO: 19216 - DNA, 58 bp, Homo sapiens
cttttgcgttctctttccctctcccaacawgscsgcctcagcaaaaaaaaaaaaaaaa

SEQ ID NO: 19217 - DNA, 103 bp, Homo sapiens; identical to SEQ ID NO: 8028

SEQ ID NO: 19218 - DNA, 352 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaam

SEQ ID NO: 19219 - DNA, 167 bp, Homo sapiens
ataatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgc

SEQ ID NO: 19220 - DNA, 541 bp, Homo sapiens
gtacacagccggtccaaggcggtgcgctgggggccgggccgcgtcgcaggtatcagaaactacaaccagcgatatccagattctgctatttgaacctatccagagtcaggggttctaagaagccacccaaggtgtgaaactggtataccttgccaggctcccgctctgcacacccagagggaaactggtaccggagtgaggattggaagaatcgtgtctgtaaaccgcctgccagccactcccttctccaggctctgtttctgcaccctgcacttaagcccagcttggtatccgactgtcccgtcctactttgggacctttgccgtggtggtcctttaccttgtgagtcccacctgtcccttttgcacttgtccaaacctatcctacaatcaaggcctacctcagaagaatatttttttcgtaacaacctttttgatttcccttgccctttgcccatctctgcctttgctgatgccccataaagtttatgagtgctghgtgtgtcaacagccctyaccataatctgagtactcatgtgatc

SEQ ID NO: 19221 - DNA, 467 bp, Homo sapiens
cataaactttatggaacattgaacatgcgaaccgtgtacttgtgccaactgttagttagttgaaactcttctttctttgaatttacgtaattttctgtctagactggccagtgagtaataatcatgtctgttcttttgtgagtagtgttattaaaactatgtttttcggattttaagataatagatcaaaaatgaatttctgtctaaatttattcaaagaacaaacttcttcgaacatttaaaatggttctggttacaacataatgtctttggcagcaacttggatggaactgggggccattattctaagtggagtaactcaggaacggaaagccaaatactgcatgttctcacatataagtgggagctaaattataggtacacagggacgtacagagtggtataatggacattggagactcagaagggaggaaggtaatggataaaaaactacctatggggtacag

SEQ ID NO: 19222 - DNA, 464 bp, Homo sapiens
  misc_feature 457: n=a, g, c or t
agaactcggcccgtcgagggagctgagagcagctccactggcccgaccccgcgggatgagaagacagcttggctccccgcaggggccgtcggaaaatacccctggggttggtctgcgaccatgacgagcgaccctattggcccaataccgggaagcgaggcggagcttcctcttctccgagccccacctgggctttcagcccgcctcaggactgtgcgcctgcgcgaagtgcactggctgtgagctggacctgggctgtcttgtgtatttggatttggacagccaactacgtgactgcagccgggactggggacgatggaagcggactgggtagtacctgttgagcctaacaaagggtacaaccccagagtactggtgcttgagcaaggaatccccctgctcacctttcatgtgcaagtcctgtttgaaaatcagtacttcacagtgtaataaaatncacctgg

SEQ ID NO: 19223 - DNA, 371 bp, Homo sapiens
atttaagaagtgtagaatatctcaaaacttttttatattgattacacattaaaatgattatattccagatatatgcagttgactcaagcaatgcatggctgagaggcaccaactccctgtgcagttgaaaatccgggtataacttgactccccaaaaacttaactactaatagcctacctatcggttgactgttgactgcagccttaccaataagataaacagtcaattaacacacatttttcatgttgcgtgtattatatactgtattcttacaataaagtaagctagaggaaagaaaatgttattaaaaaaaaaaaaaaaaaaaaaaaaaaaaaaaaaaaaaaaaawtaaaaaaaaaaaaaaaaargyt

SEQ ID NO: 19224 - DNA, 247 bp, Homo sapiens
tacgtggatttggtagacmmaccccggactgggatcatggcagccgwkactcggaacgtggcykgagcakaggcccsaccgsccyagaagcgctactaccggcaacgtgctcactccaaccccatggcggaccacacgctgcgctaagcacaaacacaaagtasgatcccagtgcattaggcagccagtctcgggagaaggggaacttgygccccagaaagggcagttacccggccagggtcacaty

SEQ ID NO: 19225 - DNA, 321 bp, Homo sapiens
taacatactctactaaaattatttaatcttgactttgtatgaaagtaccttcttcttagttggaaatttgcaagtgattttaggttggcctgtgcactagaatttatattgactttgaattagacagacatgggtttgagtcttgacctgccagcgtactgtgttcccttagacaagctctttaacatctctgagcctaagtttcctcatctgtaaagtagttatcattttttccagggttctgttcttgycttaaagatgaaagataatcgattaaacgatactctggttaaagatttattacattcsgctgggcgcggy

SEQ ID NO: 19226 - DNA, 221 bp, Homo sapiens
atgttttggataaaaataacattccaatcactattgtatatatgtgcatgtattttttaaattaaagatgyctagwtgctytttataagaccaagaaggagaaaatccgacaacctggaargatkkkygtttwcactgcttgyatgatrwwtcccattcatacacctataaatctctaacaagaggccctttgaactgccttgygttctgtgagaaacaam

SEQ ID NO: 19227 - DNA, 177 bp, Homo sapiens
caacaacaaacaaacgaagctatctgagtgaactgctaatacagaaacttaatgtagacctgtttggggtctactattgttttagaatgaaggaattgtcattattgtgcgtatatataattwgtaaataaamagtawggakatgatacggtkttaaaaaaaatcatggtaaggctw

SEQ ID NO: 19228 - DNA, 469 bp, Homo sapiens
tgacagagttttgaaagctctaagtgtctatttttataggtaggtaaaatgacattctgagaaaataggttattgacttcataaacataaagctagtaaaaggcaaaaacaggattcaatttccaaatttgtatacccaagctcttataactcagtatctccagtactccaccacactcttagtacccattgatactccactattaaaaagagatattgctggtcacagtggctcacaactgtgattccagcactttgggaggcagaggccggtggatcacctaaagtcagmmgttcaagaccagcctagcaaacatggtgaaaccctgtgtctactacaaatataaaaaattagctgagtgtggtggcatgcgccagtaatcccagctgcttgggaggctgaggcctgagaatcgcttgaacctgggargtggagcttgtggtgagcccagatcacgccattgcacty

SEQ ID NO: 19229 - DNA, 477 bp, Homo sapiens
caaatggtttgctaacccttgctcagccccacaacccactaggagctttaaaatacttaatataggatttggatttttttttttataaagctactcagataagtgtgaactcacgttcccatgtaaaatggaaattcagaattgcattgtctttggagaccatagtagtgggagagggaaaagtacctttagttccacccttggccagcaggtggtgagttttggactcagaccctgttgacaggtttgagctaaataaagctttggaacagaacagtgacactagtgagaggaatcaaggaagcagcatgtaccttctgactggctgattctcaaccaaatatacagagtagagggaatatgatagagtggaaagagcactggattgagaatttgagcttgacctcagagaacctcatgttaaagccttactatcaggaaacaraagctatcaacaaggcacacagtgttaatggg

SEQ ID NO: 19230 - DNA, 444 bp, Homo sapiens
atagaaaaactttatatggtgctttttgccagctgtgtccctggtcattgagcacaacatgtaacagtttgcccatggactattttgggaaaaacagtcgtttcatcaagggtatggcttgggtttgaaattttgtttggatcacttgccaataaactggcttccaaaaatcaaatatgaaaaatgttaagagaattggaaactaaggcagggagctctgcttgccaaattttaactattactaacctgttagaaaatatgatcgcaggccaggcgtagtggctcacgcctgtaaccccagctactcgggaggctgagacaggagaatcgcttgaacccakkaggcakwggttgcagtgagccgggattgcaccactgtactccagcctgggggacagagcaagactccatctcaaaaaaatgaawawaaaaaaaaaaaaagct

SEQ ID NO: 19231 - DNA, 419 bp, Homo sapiens
gagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcasgagagtgcttgaacccargaggcsgavgttgtggtgagccaagatcm

SEQ ID NO: 19232 - DNA, 338 bp, Homo sapiens
attccctcagtttttatctgagaatgtctagaatgtcttaatctttccgttttttgttttttttgttttgttttgtttttttttttttgagagggagtcttgctctgtagcccaggctggagtgtgtagtgcaatctcagctcgctgcaacctctgcctccctggttcaagcgattcttttgcctcggcctcccaagtagctgggattacaggcatgcaccacaatgcccggctggtttttgtatttttagtggagtcggggtttcgccgtgttggcaggcagatcacaggatcaggagatcgagaccmtcctggctaacacggtgaaaccccatctm

SEQ ID NO: 19233 - DNA, 334 bp, Homo sapiens
taagttcttcctttgggtctggttgttmwhtgtacattttaaaaatatatagcccaccatggtggttcatgcctgtaatcccagcactttgggaggctgaggagggaggatgcttgagctcaggggtttgagaccatcctgggtaacatggtgagaccctgtctctacaaaaaataaaaaaattmscttggcatgtacsatgtgtgctystacttycagctacttgggaggccagaggtgggaggatcacttgaacccaggaggtggaggttgcagtgagctgagattgygccamtgcactccavcctgggcaacagtgcaaagaccctgcctm

SEQ ID NO: 19234 - DNA, 196 bp, Homo sapiens
gccgccgccgccgccaccgcctcccgcttcccggtgtcgcgcggctgccgcccttcgcggtgcaacagccacaaaacccgccgcctcgggccggggccgcactcgggaacggggcgtcgccgmtacagccgctgccttgggagccggygagcggtccgcgcggyyccgggcaccacgggggcgggagcctgaggar

SEQ ID NO: 19235 - DNA, 505 bp, Homo sapiens
tgacactgaaagtaactagtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgkttctttctttggtatctattaactggtcagtcaaaagctattaaagaatgtttttaaagtcacctaatgctgccagtttgttaaatttggtatacattttaagaa

SEQ ID NO: 19236 - DNA, 513 bp, Homo sapiens
ttctgttggtctctgccttccagggaacaggaattttaggattcaggtattagttatctctaaaaattatcttgagtagttaaaagtctttgaatgctcaaaattaactattctagactccttctgggaagtatgatggcaattgccctatgctatggctcagtagttacggyttttgccgtatcacaggggcagactgggttcsattcccggcacaggaagtwagacttttttggtcttaatatctggataaccttwctctatkskcttctcctcagcagactatcttaaatttttcgttctctgcacctgggaggttaccttcagtaaatttgcaaaagccasaaatattggccatttggcctggctaaagtcaggtaataagaaattttaaaaggactttattaaagagtgctatggttaaaaatcagcttaattaaaaagtggatattcmmgctctaacagcctgtactcccttgggaaaamcaagaggcaccagagaactttccctgc

SEQ ID NO: 19237 - DNA, 308 bp, Homo sapiens
gagcgaggaggcgcggcctcccgaggaggggcccggtggcggcagggccaggctggtccgagctgaggactctgcaagtgtctggagcggctgctcgcccaggaaggcctaggctaggacgttggcctcagggcaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagc

SEQ ID NO: 19238 - DNA, 467 bp, Homo sapiens
ctcgattaggcgtatgggttttgaaaaagagatttttcagaagattgtcagcttcagtattcacgttccatcgwrtcatctgggtctgttagtgtagtgaccctcagtgcagtctgtcccagcgtttatgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttadgatgcakygtgaagcagaagtccatattgcaattatgattttagaaggaactaagcattttactcacacccacmgcagcmagaatgacttyctgcagcagatatt

SEQ ID NO: 19239 - DNA, 401 bp, Homo sapiens
ttttgtttctttttctttctttctttcttttttttttttttttttaaattccaggcacatgatgctcgaggggggcctactataatagcaaacatcgattggggaggggaagaccaaaaaaattgttcatgaactcatgaacaattgagtgtggaaatgaactgcagtattttcacacaatagaatacttcctggcagtgaaaatgatctacagatagacaaagcgacatgacgctcagaaacttaatatgcaagaaaaagcaagtcacagggtaatatgtatgtatgattcaacttgtataaagttcaaaaatctgacacactaaacaatctgttgttgagaagggaaatatatcataatthhwktttcctttgagacagagtctctgttgccaggctgg

SEQ ID NO: 19240 - DNA, 476 bp, Homo sapiens
gggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgkaccattttcttgkttaactttagcatgktgktgatcatggatcatactc

SEQ ID NO: 19241 - DNA, 369 bp, Homo sapiens
tttattcactgatatattccaaaaaatgtgttattttaacaaggaattagttttttaattctttcactgaaaaaggaaaaagcmgtaaatgattkygttaaatgtcattggcaacttaatcagaaactaatccaaacaactttaggccttctagattaaagcatttgtcccttactagttacatttacctattaaaattgacttamsaattytggttatgagcacgcaggagtctcacataaactgacagcacaacttggagacaatgtayyaatatyttaaatctcatgttttacaaacttttagagcmsaagtctgtgttaaatcactttagagatgacttgcacaattctgcttgygtgtgtgtgy

SEQ ID NO: 19242 - DNA, 85 bp, Homo sapiens
aaggtctggagcgaattccagcctgcwkggctgatragcgaggcattagtgagattgagagagactttaccccgccgtggtggtt

SEQ ID NO: 19243 - DNA, 63 bp, Homo sapiens
ctctccgccagaccgccgccgcgccgccatcatggacaccagccgtgtgcagcctatcaagct

SEQ ID NO: 19244 - DNA, 453 bp, Homo sapiens
gacttggaatctaaaacaaaagcaaaaagataaggaaaatattaatgaaaaattgaaatggaggctagccttgatccagaaggtccaccttctcaccttcaggacacatggcttaatgagcagatgatgctctttgactgggatacaggacttgatgggtgggacacaggctgaatttcagctttcactcttcagtgggatcttctagtgcatggtgcaacctgcataattatatatagcagccctgcaccttctacataataataggcctagaaagagattagaaacaaaatagaaacgaaaggaaaaaatagaggaaaatttatctgagctaaagaaaggctcagttgaagtcattagtttgaacagccttgctgattgtcaagagagtaagtgcaaaagtatccataattagtctgcattcagatgcaggaacctggtgctagagaagct

SEQ ID NO: 19245 - DNA, 136 bp, Homo sapiens
gggttatctttgtctcgctgcctcgcgctcactcgctcaactcggcgccgccgcggccccacgctccgggcccgtcctcgaggcgcgcggcgcggggcgcgggcgccggggcctgasgcggcgggcgacgcccggg

SEQ ID NO: 19246 - DNA, 459 bp, Homo sapiens
actaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccagcagaagactgatttttggaaatatgtatttgggagacagtcacgtcctattgaataccttgtgctggtgctgccatcgaaaaatctggttacactctggggaggactgctaccactgcagaacctgaaccacttcggccgtgagatgagtgtccggcctgagcaggcacaccatgaatagatacacaacaatcaggcagmtcggggatggaacctacggttccgtyctgctggggaasaagcattgastctggggagctgatcgctattaaaaaw

SEQ ID NO: 19247 - DNA, 522 bp, Homo sapiens
ttttgttgaatttgctcactgctttcttcctggagctcaagacagtgcctagatcaacacaggcactcaataaatatttgtagaaagaatgtataagtatccatggccaggcgcggtggctcacacctgtaatcttagcacttttggaggccaacgtgggcagatcatttgagcccaggagtatgagaacggcctgggcaacatagggagaccttctctctaaaataaattaaaaaaaaaataggcccggcacggtgggtcatgcctgtaatcctagcactttgggaggccgaggtgagtggatcgcttggggtcagacgttcgagaccagcctggccaacaaaatgaaaccccgtctatactaaatatacagaaaaattggccgggcatggtggcgcacgcctgtagtcccggctggttggggaggctgagacgggagagtcgcttggactggggaggcsgargttgcagtgagctgagatcatcccattgcactycagcctgggtgacagagcgagactt

SEQ ID NO: 19248 - DNA, 492 bp, Homo sapiens
  misc_feature 366,383,390,393: n=a, g, c or t
agcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgncgycgrctccgcaccgncgscctncgnccgmcsagaccgvcagacccgaaccccgatcccgacccccacggctgtgcctcgsccgcggacccggggagccccgscgctgccgcccaagcctgagcg

SEQ ID NO: 19249 - DNA, 490 bp, Homo sapiens
ctctacaaaaaatacaaaaattagccgggtgtggtggcacatagctgtagtcccagctacttgggaggctgaagtgggaggattacttgaacacaagaggtagaggctgcagtgatcgcgccactgcactccagtttgggcaacagagtgagaacttgtctaaaaaaaaaaaaaaagaaagaaacacagaaaaggtacagtgaaaatacaatataatcttatggaaccattgtcctatatgtggyccatcattgactataacattgytgtgtagcacatgactgtaattycttttacttattktctttgwtgwgtgtcctcactaacaagaacctaacttcatgagggcacagatattttctgtttgaatcatcatactttatttccagtgtctggaatactgcctagccacatagtmaattcttaaaaaatatttgtagaatgaatcacgtatataaagcttttaacagcacagtatgtgattcattgc

SEQ ID NO: 19250 - DNA, 477 bp, Homo sapiens
tgtctatcagtaaactagatcattaacactgcgcctgcccctcctgctcacgggcacgttaggaacatgcgcttggataaaatccaagccagagatttagaaaccagtgcgtggtgccagctctcagccttggaaccacaagcccatttttcttaaaaagggatctggactggcatccaaagagatttcagtcccctcatgtaggtttaaccaccatgggcaaggcagtctctctcccaggtattcctctcactaggtgctctgctctagaaatgaagtctaaaagcagccccatcaatacagaacagagttagaaccacccggagagatttaatctggaatcccagcaagttgtgaaatggaaagactagtcggccagagagctgaggtctcacagtgtgcaaagaccagtcctcagtatctgcacccatccatttgagtttcargtgaagcctargatttgggagctcaatacaa

SEQ ID NO: 19251 - DNA, 366 bp, Homo sapiens
ggccccgccttggtggcggcgccccctcgcggtccagaggcagacgcatcgggwrggctcgggtctccagcccggccgggaggagggaccgggtctgcggagcggggactcggggcctcggcggggcgcgcacacgcaggcggrrcggcccggrrwrcggggcctctgcgcggctgaccaggctcccagagcgtcagcgccgcccatggccgagccgstccagccagaccccggggcggccgaggacgcggcggcccaagctgtggagacgccgggctggaaggccccggaggacgccggccccccagcccggaagttatgagatccgacactatggaccagccaaagygggtcagcacgtycgtg

SEQ ID NO: 19252 - DNA, 519 bp, Homo sapiens
cattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgtatttcctattatgaattgcttttgcccattttcctttttttaattatgaaagtctaatgactaccttctcattgkataaaaaacacagttctttgaatagagagacccttttctccaatgctaccaatcacattccacttaccacagtttaacatacatcctctagtcacctttycgtacgaatatacatacacataaaaacactttttacataaatag

SEQ ID NO: 19253 - DNA, 480 bp, Homo sapiens
tcttacaaggtctgtttggtttaatcccatctcagagcctaggtaatttcacagcctttgcaatgtcagaatgttgagtggagaagggtaggggaaagagaaaagaagatactcattcctgatgttaccactcgcttagccatacaaccttcaacagatgactttctaacctttggggtgtctttgatctgtaaaatggagagattgaactaggaaatctctaaggtcctttatagctctactttttctacattatatggttttacctccctagtgcctaacccaggcaaggtgttatagaaggccctcaataaaatataacatactcggtcaatcggggcaagatggccaaataggaacagctccagtctgcagctcccagtgagaccaacgcagaaggcaggtgatttttgcatttccaactgaggtaccctcttcatctcattgggactggttagacagtgggtggagcccacagag

SEQ ID NO: 19254 - DNA, 78 bp, Homo sapiens; identical to SEQ ID NO: 7868

SEQ ID NO: 19255 - DNA, 419 bp, Homo sapiens
attgtgactttgggccaggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgb

SEQ ID NO: 19256 - DNA, 375 bp, Homo sapiens
ttgtttgtttgtttgcttgttttttgagacmsagtctcgctctgtcacccaggctggagtgcagtggcgccatctgggctcactgcaagctccgcctcccgagttcacgccattctcctgcctcagcctctcgaggagctgggactacaggcaccggccaccatgcccagctaatttttttgaattttttttttgtattttttttttttttagtagagacggggtttcacagtgttagccaggatggtcttgatctcctgacctcatgatccacccgcctcggmctcccaaagtgctgggattacaggcatgggccamcgtgcccggcctmatttttgkatttttaatagagacggggtttycaccatgttggty

SEQ ID NO: 19257 - DNA, 177 bp, Homo sapiens; identical to SEQ ID NO: 7812

SEQ ID NO: 19258 - DNA, 287 bp, Homo sapiens
tggagtgtttttttttttttttttttttgagacgggatctcactctgtcacctaggttggagtgcagtggtgcaatcttggttccccgtaacctccaccaccgggctaagggatcctcccgccccagcctytcaagtagctgggaccataggtgcacgcctctacgtccggctaattttttttgtatttttggtagagaccggatttcaccgtgttgcccagtctgttctcgaactcctgagctcaggcggttcacctgctttggcctcccaaagtgctgggattty

SEQ ID NO: 19259 - DNA, 266 bp, Homo sapiens
ctctgcgtgcgccggarrctgccgwrgcgggwrggccgccwracttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcrccgctggygtgtcccttggtggagagggcgctgccggy

SEQ ID NO: 19260 - DNA, 58 bp, Homo sapiens
aaatttccgctttctttctgcagcaggaaccgtgrmtgctggacaagaggggtgcggy

SEQ ID NO: 19261 - DNA, 204 bp, Homo sapiens
gagccgtcagtccggcggccgcggggcmmgrmgggcgcgamrctgccwmcksaccggcgcaggctaggwkggggcggyytgagtgccgtagccgagccgkkgctggagcgctgykgtctgacctacgagaaacagggcaaccagcgccgtccccagtgacaacctccccacatacaagctggtggtggtgggggatggggrhvy

SEQ ID NO: 19262 - DNA, 329 bp, Homo sapiens
agagtccggctgcctggggcgggcggcgcgtgtctgcagctgctccgggtagcccgctaggcgcgccgtccccagccccgccgccggccctcggtgcgcccggmcgcctgcacccmcaggagcagctgctgtgaataaacacagaagtggagctgggggactgattagaagccwmattcastgcacctgggccccagcaggcccagccaggcgtggaggaagaggcattgmggactttscttacctgtwyttccagctyacccactgycagcagagaatgctgtccagtttcaacgagtggytttggcaggacaggttctggttaccas

SEQ ID NO: 19263 - DNA, 72 bp, Homo sapiens
gagattgctccactgtactccagcctaggcaaaggagctagactctgtctcaaaaaaaaaaaaaaaaaagct

SEQ ID NO: 19264 - DNA, 348 bp, Homo sapiens
gttttaaaaattattacacgagatacagcctttatttcttggcctagagcagtaattatcattttgggatttaaatatgattctactgttgttgatggctcttttacaaaagttctttccattaacaaggtccaatactatatttaaaaaaatgtccaagaggccctttgagctatatcacctgcttgtctttagcagaatcctgaactggataactttaaaaagtttgtcagcctaagaaaatggaagagtgggtaactgtgtggctaactgatgctgtgaccgttaccacgcatgggactgggcactttatgaacggttttacatttggaatcacaaactgaagag

SEQ ID NO: 19265 - DNA, 439 bp, Homo sapiens
  misc_feature 382: n=a, g, c or t
tcatttgctaatataaattcagttyyattttaccattttagagactactaatgattaaatgtasaaggagagggtgcacatgtttttatgtggagtgtttaaaagataaatttataccactgtaatgtgcatcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgbttaatttgkttaaatcaacatagcatgaaacaccamataaaatgttngacatagktttacttttagcttkctcatatgktataacttcactcagattgattctt

SEQ ID NO: 19266 - DNA, 330 bp, Homo sapiens
ctttgcctgctgcaggtcctgtcaacctgcccacaggcatctctcgcgtccccactggctaccctagcgacctcaagccagtcacctggaaccagcaccagctggcccacctacagcagatgtgcarcgaggctartgggacgccagcccctggcctgacaggcaagcatgcggcaggacgcgagttggcagggcctggctttgtgggcaaggcccctgsctacccgcaggaactctgcctggcgcartccttccatytgaagccacccctggaaaagccgaccccatycccaccagkcaacggsatggcagccccattggsctacccca

SEQ ID NO: 19267 - DNA, 319 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgakgcaggagaatggcttgaacctgggaggcggagattgcaagatcgcaccactgsaccccarcctgggcaacaaagtgagactccgtcgcaaaaaaaaaaaaaaaaaagct

SEQ ID NO: 19268 - DNA, 313 bp, Homo sapiens
atgcggatgcgctcggttagaacgcagttcttggtgccacgactgggagacagtcctcaggccctcccctcagggagctcactgtccggggagggacagccagcaatagttcctggccggccaggagaggcagaggcagaggaagggaagggtcagctgccttgaggtccctgcctgctaacctgacggtatgctttcaccatgccggtgaccccagccccaggaccacgagcaactcgcctggctcccttctctccgtctgcctcctggccgcggggcccggaragctgggagccagarggtgtaaatgaag

SEQ ID NO: 19269 - DNA, 160 bp, Homo sapiens
tctagaaattcatgtaaatggaaatcatatttatgtctggcatcttttwttttttcctattttaatactttyatgttcaggggtacatgtgcaratttgwtacataggtaaatgtgtgwcatgggggtttgyggtatagattagtacccattagttattw

SEQ ID NO: 19270 - DNA, 90 bp, Homo sapiens
ccggagggcggagcttccagtgagccgagatctgcgctccaacctggggacagagcgagactccctctsaaaaaaaaaaawamaaaagct

SEQ ID NO: 19271 - DNA, 110 bp, Homo sapiens
gttggacatgggttgtaaaaataaaaccaggaacacacaaacagacacacacacaaacacacccccacctcctgcaattaaacagtagcatcgccaaaaaaaaaaaaaam

SEQ ID NO: 19272 - DNA, 132 bp, Homo sapiens
cagcccaacactggagcgtctcctgctcgcgcacgccakaagcagctcggggtctctccgccgccccttggccatggccgytgtgcckacrgcgcccgytcccctgcgctccaggggcccccgccgctgcad

SEQ ID NO: 19273 - DNA, 101 bp, Homo sapiens
agcctgggggacaggccggcgcggctgggagckgrtgggcggmcggkaggccggagcabcacggccghaggacctggarctycggctgcgtcttcccgcav

SEQ ID NO: 19274 - DNA, 265 bp, Homo sapiens
gaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgcctt

SEQ ID NO: 19275 - DNA, 325 bp, Homo sapiens
agtggatagcttaagcccaggagttcaagaccagcctgggcaacatggcaaaatcctatctctacaaaaaaaaaaaattagccaggcgtggtcgtgcatgcctgtagtcccagctacttgggaggctgaggcaggagaatcgcttgaaccctggaggtggaggttgcagtgagccgagatcactccattgcactccagcctaggcaacaagagcaaaactctgtctcaaaaataaaaaataaaagaaaaaacagaagaaaataccaagtgtggcaaggatgttgagaaaatggggcccttgtgcactgttggtgagcatgtagaa

SEQ ID NO: 19276 - DNA, 171 bp, Homo sapiens
agagcgcagcgcgcacgcccagcgagttccagaggcgccagtggaagctgcggcggcggtgtctcgcgttcggcgggatttctcttcgctccggctcggcctaggtctacgtccccagctccagccgccggmtcggactcggtctctgacccccaactbggtcccctagty

SEQ ID NO: 19277 - DNA, 90 bp, Homo sapiens; identical to SEQ ID NO: 7855

SEQ ID NO: 19278 - DNA, 182 bp, Homo sapiens
ggagtgcaaaaaattggctgggtgtggtggcgggcgtgtgtcgtcccagctgcttgtgaggctgaagcgggaaaatggcatgaacctgggaggtggagcatgcagccagccaagatcgggccgctgcactccagcctgggggacagagcgagactctgcctcaaaaaaaaaaaaaaaaagct

SEQ ID NO: 19279 - DNA, 59 bp, Homo sapiens
aagctccagcggcggccacggcggcagttccagcggyggctacggyggtggcagttcck

SEQ ID NO: 19280 - DNA, 353 bp, Homo sapiens
caagtggtggggattacaaaggtgcatagttgattaagggtaacttagagctcaagatagagtgtgtctgccacagaaatgaccatcaacgtcgctgttcctgtttcattgcatcatatttgagccatagtataaggtaggagtgacagcagtagcagcagaactgggacatccacatgaaggatgtgaatcaaaccaatacattttttctgcaggatcctgcatcacagcaggtgaagggtatccacttcatgtggagacagatgagccaaaggtagatgtaaatctcacttaaaagggccacctggctctgaggaaactatagacacagtccgtagtgatgaatatcagaa

SEQ ID NO: 19281 - DNA, 107 bp, Homo sapiens
tagcaaaagaaagaatgagggaattaaaatgatacactagaaaatatttaacacaggagaaggcaacaatgtagacatagagaaatttaaaaagacctaagacatac

SEQ ID NO: 19282 - DNA, 377 bp, Homo sapiens
attctagaaacagtctctccccagctcacttggctgaagatactaaagagaactagatgttatctagtgttatcctgctgatcccaatttcctatagttctggcaccagaaaatcctgaatgataggtttttctgaagctgctgacatcgggtcagccctcaacaccatcacctttggccatgttcaggaagtactcaaagatcatggctcaaaagtctgcagagcagagacaagagattgacaaagaggtgttgatgagggcaataaaagcaaaggtggctttatcacggtgagctacttctcacaggagtcgggatccacatctgcagactacacaaaaacaaacaacacagattaaaagcacaatcaccattga

SEQ ID NO: 19283 - DNA, 270 bp, Homo sapiens
tgttttatttttgtagagatggggtcttcctatgttgcccaggctaatctcaaactcctgggctcaagtgatcctctcacctcagcttcccaaagggattaaaggcatgggccatgatgctcagccacagttttcttttcttttcttttctttttgtttttttttgagaaggagtctcactctgtcgctcaggwkggragtgcastggcgcaatcttgtctcactgcaacctycgcctcctggattcgggcgattctyccgcctcagctt

SEQ ID NO: 19284 - DNA, 348 bp, Homo sapiens
actttccctctgagtccttggacaccttacctaacctcttggaagctcctgtctgtgaagggtgtgcacagagagcttcggtagcctgcgaagcagccattttcacttccacggagcagatgctggcctgggtgctggaatatggaaatgaggaagatcctgcctgaggatttcatgacagtgctgcgattaccgacgtgagccactgtgcccagcctcactttaaaaaaaaaaaaaggttatgaagcatytcaacacaagacctcctttgctcatcacaaccacccagtgaagcaggcaagacaacagaaactycccacctgtgatagatgtgaggcctgaagtcts

SEQ ID NO: 19285 - DNA, 338 bp, Homo sapiens
  misc_feature 288: n=a, g, c or t
agctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatattngatgcctatgttcctcctgagggtgatgcacgcatatcatctctttcaaa

SEQ ID NO: 19286 - DNA, 63 bp, Homo sapiens; identical to SEQ ID NO: 7774

SEQ ID NO: 19287 - DNA, 80 bp, Homo sapiens; identical to SEQ ID NO: 7777

SEQ ID NO: 19288 - DNA, 101 bp, Homo sapiens; identical to SEQ ID NO: 7753

SEQ ID NO: 19289 - DNA, 108 bp, Homo sapiens; identical to SEQ ID NO: 7744

SEQ ID NO: 19290 - DNA, 101 bp, Homo sapiens; identical to SEQ ID NO: 7753

SEQ ID NO: 19291 - DNA, 108 bp, Homo sapiens; identical to SEQ ID NO: 7744

SEQ ID NO: 19292 - DNA, 496 bp, Homo sapiens
ttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttakgaaacattgtcttgctcattatagagagttaagactgtgcataaaatactgaagtgcctcttttttattaggctcatatgtttgttcttgcaaagcgagwtgcctattgtgattggtgttagatctgtaagaagctgtgttttttccacaagaataatcgacgaccagtttgagagcatctctcgcgttctttttctgtctgcttactgtccttgac

SEQ ID NO: 19293 - DNA, 108 bp, Homo sapiens; identical to SEQ ID NO: 7744

SEQ ID NO: 19294 - DNA, 63 bp, Homo sapiens; identical to SEQ ID NO: 7774

SEQ ID NO: 19295 - DNA, 108 bp, Homo sapiens; identical to SEQ ID NO: 7744

SEQ ID NO: 19296 - DNA, 108 bp, Homo sapiens; identical to SEQ ID NO: 7744

SEQ ID NO: 19297 - DNA, 80 bp, Homo sapiens; identical to SEQ ID NO: 7780

SEQ ID NO: 19298 - DNA, 108 bp, Homo sapiens; identical to SEQ ID NO: 7744

SEQ ID NO: 19299 - DNA, 108 bp, Homo sapiens; identical to SEQ ID NO: 7744

SEQ ID NO: 19300 - DNA, 108 bp, Homo sapiens; identical to SEQ ID NO: 7744

SEQ ID NO: 19301 - DNA, 80 bp, Homo sapiens
tttttcgcaacgggtttgccgccagaacacasgtgtcgtgaaaactacccctaaaagccaaaaaaaaaaaaaaaaaagct

SEQ ID NO: 19302 - DNA, 101 bp, Homo sapiens
acagttaactttaggaccmymgccaaaagatagaaacagcataaacgtcaaaataaaaagaagccaataaagataaacacaaaaaaaamaaaaaaaaagct

SEQ ID NO: 19303 - DNA, 489 bp, Homo sapiens
  misc_feature 440: n=a, g, c or t
atttaattcagcaggactttgttgaccatacattatgagggaaatatttaatactatttggagactgatatattttcctcttatctagagtaaaataaattataagaagtgatgaaaacaaccatttaattagacttaagtaagtttgaaaagcaactctgtgaatttaagtgtttttaataatttcataggtgtctcattctataaactcaatggctattgagttaatcttcaagttattttcctacgggcccttttaagagaaggttggaaagaatgaaccatgtttaccagagatgtttcccaagatggacaacagactgaccatgttgattcagaactaagtactaataaaaaggagtttaataagaagtctaatagaaatcaaattgtatttatcaactttaattctattttaatgcacgagtcctaacagccanacgactaatatgctgacatttcttaattcattttttctgactgtgctcc

SEQ ID NO: 19304 - DNA, 108 bp, Homo sapiens; identical to SEQ ID NO: 7744

SEQ ID NO: 19305 - DNA, 81 bp, Homo sapiens
ctttttcgcaacgggtttgccgccagaacmcaggtgtcgtgaaaactacccctaaaagccaaaaaaaaaaaaaaaaaagct

SEQ ID NO: 19306 - DNA, 81 bp, Homo sapiens
ctttttcgcaacgggttysccgccaramcacaggtgtcgtgaaaactacccctaaaagccaaaaaaaaaaaaaaaaamgct

SEQ ID NO: 19307 - DNA, 81 bp, Homo sapiens
ctttttcgcaacgggtttgccgccagaacacaggtgtcgtgaaaactacccctmmaagccaaaaaaaaaaaaaaaaaagct

SEQ ID NO: 19308 - DNA, 205 bp, Homo sapiens
ttaagcatgttaacaaaaatagcaaaatatgaaaataagctgggcatggtggcacacgcctgtaatcccaactactcgggaggctgaggcatgagaatcacttgaacccaggaagcagaggttgcagtgagccgagatcatgccgccgcactccagcctgggcaacagggcgagactctgtctcaaaaaaaaaaaaaaaaaagct

SEQ ID NO: 19309 - DNA, 102 bp, Homo sapiens
cttttcggagggtgsygagctagtctgcggmcgctgtataccctcctccacttcccgctgcagccaataaaggccgttcctaccataaaaaaaaaaaaaaaa

SEQ ID NO: 19310 - DNA, 80 bp, Homo sapiens; identical to SEQ ID NO: 7780

SEQ ID NO: 19311 - DNA, 108 bp, Homo sapiens; identical to SEQ ID NO: 7744

SEQ ID NO: 19312 - DNA, 108 bp, Homo sapiens; identical to SEQ ID NO: 7744

SEQ ID NO: 19313 - DNA, 109 bp, Homo sapiens
cattggtagcttgatggggatggcattgaatctgtaaattaccttgggcagtatggccattttcacgatattgattcttcctacccgccgcaaaaaaaaaaaaaaaaaa

SEQ ID NO: 19314 - DNA, 385 bp, Homo sapiens
acacaattcattaattcrgcaggactttgttgaccatacattatgagggaatatttaatactatttggagactgatatattttcctcttatctagagtaaaataaattataagaagtgatgaaaacaaccatttaattagacttaagtaagtttgaaaagcaactctgtgaatttaagtgtttttaataatttcataggtgtctcattctataaactcaatggctattgagttaatcttcaagttattttcctacgggcccttttaagagaaggttggaaagaatgaaccatgtttaccagagatgtttcccaagatggacaacagactgaccatgttgattcagaactaagtactaataaaaaggagtttaataaggaaaaaaa

SEQ ID NO: 19315 - DNA, 101 bp, Homo sapiens; identical to SEQ ID NO: 7753

SEQ ID NO: 19316 - DNA, 108 bp, Homo sapiens; identical to SEQ ID NO: 7744

SEQ ID NO: 19317 - DNA, 169 bp, Homo sapiens; identical to SEQ ID NO: 7766

SEQ ID NO: 19318 - DNA, 63 bp, Homo sapiens; identical to SEQ ID NO: 7774

SEQ ID NO: 19319 - DNA, 133 bp, Homo sapiens
tattacaaagctataagatagcatagtactggcataaggataggcatataaatcagtagaatagaaatgagattctaaaaaagtgatactgcgtagaaacgccattacatttatggttaattgatttttcaga

SEQ ID NO: 19320 - DNA, 80 bp, Homo sapiens
ctttttcgcaacgggtttgccgccagaacacaggtgtcgkgaaaactacccctaaaagccaaaaaaaaaaaaaaaaagct

SEQ ID NO: 19321 - DNA, 108 bp, Homo sapiens
gaggttgagacaagagaatcacttgaacctgagaggcagaggttgcagygcagcctgggtgacagagggagactccggccccctcccaaaaaaaaaaaaaaaaaagct

SEQ ID NO: 19322 - DNA, 119 bp, Homo sapiens
aagatggattttggagatgttgcctgggctggtcttgaactcctgggctcaagtgatccacccamctvakyytcccaaagcgctgraattataggcatgakccactgcgcccggcctaa

SEQ ID NO: 19323 - DNA, 101 bp, Homo sapiens
acagttaactttaggaccatagccaaaagatagaaacagcataaacgccaaaataaaaagaagccaataaagataaacacawaaaaraaaaaaaaaaagct

SEQ ID NO: 19324 - DNA, 80 bp, Homo sapiens; identical to SEQ ID NO: 7780

SEQ ID NO: 19325 - DNA, 390 bp, Homo sapiens
taaatttgaaataataataggtactggatttatgcaaatgtctttgtctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaggcgtggtggcatgtgcctgtagtcctagttgctgaggtaagaggattgcttgmsssccaggagttcaaggctgcagcaagctttgattgcgccactgcactccagccttggcgacagactaagacgctgtctcaaaaaaaaacaaaaacgccaaaaaaaaaaaaaaaaag

SEQ ID NO: 19326 - DNA, 168 bp, Homo sapiens
ctggacaaatgacttgaatagacagttctccaaagaagatatgcaaatggctcaacattattaatcattagggaacattgttaataattagtggtatytcamcakkgaratttaayttytwmccawttrgrwkggtwttattaaaaaccaaaaaggggaawaaaagcy

SEQ ID NO: 19327 - DNA, 387 bp, Homo sapiens
tgattatgtgtcttggggttgctcttcttgaggggtatcttagtggtgttccctgtactttctgaatttgaacttgggcctgtcttgctaggttggggaagttcttctggatgatatcctaaagtgtgtyttccaatttggtccattctccctgtcactttcaggtatgccagtcattcatgggtttggtcttttcacatagtcgcatatttcttgtaggctttgttcactccttttcattgttytttctctaatcttgtctttatgccttatttcagcaaggtgatcttcagtctctgatatcctttcttctgcttcatcgatttgtctattgatacttgtgtatgcttcaagaagttctcatgctgagtttttcarctccatcag

SEQ ID NO: 19328 - DNA, 169 bp, Homo sapiens; identical to SEQ ID NO: 7766

SEQ ID NO: 19329 - DNA, 169 bp, Homo sapiens; identical to SEQ ID NO: 7766

SEQ ID NO: 19330 - DNA, 108 bp, Homo sapiens; identical to SEQ ID NO: 7744

SEQ ID NO: 19331 - DNA, 101 bp, Homo sapiens; identical to SEQ ID NO: 7753

SEQ ID NO: 19332 - DNA, 404 bp, Homo sapiens
aacctaatcaagcctgggcaatggcgggcgcccctcccgcagcctcgctgccgccttgcaggttgatctcagactgctgtgctagcaatcagtgagactccgtgggcgtaggactctycaagccagtgagatgaactcggtacctcagatggaaatgcagaaatcaccgtcttytycatcgstyacgctgggagctgtagaccggagctgttcctattcggscatctttgstcctycctgsaactaactycattcttaattgggtctcactctgtcacctaagctggartgcartggcgtgatggcgtgatctcggstcattgsaacctytggcttccargctyaagcagtccttccamcttarcctyccargtarctgggactacacgtgcgtgccacacgtg

SEQ ID NO: 19333 - DNA, 80 bp, Homo sapiens; identical to SEQ ID NO: 7777

SEQ ID NO: 19334 - DNA, 499 bp, Homo sapiens
gtttttaagcatgtcagaaggattttttcctgacatggtcaattttcaggactttgtctcctgttttgcttagggaattaatagagaaatgagaagttttctaaatcagaacatgtaggagagatttaaagtaacaccctgattgtgtaattaattcttagttgtaaattcattttgatggtgttaattctctgcctgaggctcgaagctagtttattgcacctatggtgctatactcattggatacccaacgccaacaaggccttaagaaaggaaagatttgccctgatttttaaaattttttttcttttttaaaaaagaacaattgtgttacaacacagacacattatttgttcttagttctgcttacaaaagttagcaaaaatactcaatccttttaacattttataaatgaataatgaaaaatggtgggcttgtactcatcttcatatgatatatatttttaggttaccaagttagtttacttttctcacagtga

SEQ ID NO: 19335 - DNA, 63 bp, Homo sapiens; identical to SEQ ID NO: 7774

SEQ ID NO: 19336 - DNA, 9 bp, Homo sapiens
tgtcagttg

SEQ ID NO: 19337 - DNA, 10 bp, Homo sapiens
cccaactgac

SEQ ID NO: 19338 - DNA, 11 bp, Homo sapiens
aatagaattag

SEQ ID NO: 19339 - DNA, 11 bp, Homo sapiens
aactaaattag

SEQ ID NO: 19340 - DNA, 11 bp, Homo sapiens
gcacacctcag

SEQ ID NO: 19341 - DNA, 11 bp, Homo sapiens
agataaatcca

SEQ ID NO: 19342 - DNA, 9 bp, Homo sapiens
cttcagttg

SEQ ID NO: 19343 - DNA, 14 bp, Homo sapiens
ttgtagataggaca

SEQ ID NO: 19344 - DNA, 11 bp, Homo sapiens
agataggacat

SEQ ID NO: 19345 - DNA, 16 bp, Homo sapiens
cataacagatggtaag

SEQ ID NO: 19346 - DNA, 10 bp, Homo sapiens
accatctgtt

SEQ ID NO: 19347 - DNA, 13 bp, Homo sapiens
tcaagataaagta

SEQ ID NO: 19348 - DNA, 13 bp, Homo sapiens
agttgggaattcc

SEQ ID NO: 19349 - DNA, 12 bp, Homo sapiens
agttgggaattc

SEQ ID NO: 19350 - DNA, 10 bp, Homo sapiens
tgggaattcc

SEQ ID NO: 19351 - DNA, 14 bp, Homo sapiens
tcagtgatatggca

SEQ ID NO: 19352 - DNA, 12 bp, Homo sapiens
taaaacaaaaca

SEQ ID NO: 19353 - DNA, 8 bp, Homo sapiens
tttagcgc

SEQ ID NO: 19354 - DNA, 8 bp, Homo sapiens
tgagggga

SEQ ID NO: 19355 - DNA, 11 bp, Homo sapiens
ggaccaatcat

SEQ ID NO: 19356 - DNA, 8 bp, Homo sapiens
cctgggga

SEQ ID NO: 19357 - DNA, 9 bp, Homo sapiens
tgaccgttg

SEQ ID NO: 19358 - DNA, 9 bp, Homo sapiens
tccaacggt

SEQ ID NO: 19359 - DNA, 9 bp, Homo sapiens
ttcctggaa

SEQ ID NO: 19360 - DNA, 9 bp, Homo sapiens
ttccaggaa

SEQ ID NO: 19361 - DNA, 8 bp, Homo sapiens
ttggggga

SEQ ID NO: 19362 - DNA, 12 bp, Homo sapiens
gaatgggatttc

SEQ ID NO: 19363 - DNA, 8 bp, Homo sapiens
agagggga

SEQ ID NO: 19364 - DNA, 12 bp, Homo sapiens
gaaaacaaaaca

SEQ ID NO: 19365 - DNA, 8 bp, Homo sapiens
gaagggga

SEQ ID NO: 19366 - DNA, 10 bp, Homo sapiens
agcatctgcc

SEQ ID NO: 19367 - DNA, 11 bp, Homo sapiens
tcccaccttcc

SEQ ID NO: 19368 - DNA, 11 bp, Homo sapiens
gaggcaattat

SEQ ID NO: 19369 - DNA, 8 bp, Homo sapiens
agagggga

SEQ ID NO: 19370 - DNA, 16 bp, Homo sapiens
ggactcacgtgctgct

SEQ ID NO: 19371 - DNA, 12 bp, Homo sapiens
actcacgtgctg

SEQ ID NO: 19372 - DNA, 12 bp, Homo sapiens
cagcacgtgagt

SEQ ID NO: 19373 - DNA, 8 bp, Homo sapiens
tcacgtgc

SEQ ID NO: 19374 - DNA, 8 bp, Homo sapiens
gcacgtga

SEQ ID NO: 19375 - DNA, 8 bp, Homo sapiens
catgggga

SEQ ID NO: 19376 - DNA, 14 bp, Homo sapiens
ctctccggaagcct

SEQ ID NO: 19377 - DNA, 10 bp, Homo sapiens
tccggaagcc

SEQ ID NO: 19378 - DNA, 11 bp, Homo sapiens
agtgactgaac

SEQ ID NO: 19379 - DNA, 9 bp, Homo sapiens
tgtggtctc
